US012077763B2

(12) United States Patent
Puralewski et al.

(10) Patent No.: US 12,077,763 B2
(45) Date of Patent: Sep. 3, 2024

(54) RNA-BASED CONTROL OF POWDERY MILDEW

(71) Applicants: Greenlight Biosciences, Inc., Lexington, MA (US); United States of America, as represented by the Secretary of Agriculture, Beltsville, MD (US)

(72) Inventors: Adriana Puralewski, Cary, NC (US); Christopher Lawrence, Blacksburg, VA (US); Upendra Kumar Devisetty, Morrisville, NC (US); Sambit Kumar Mishra, Cary, NC (US); Krishnakumar Sridharan, Cary, NC (US); Lance E. Cadle Davidson, Geneva, NY (US); Anna N. Underhill, Geneva, NY (US); Yufeng Fang, Durham, NC (US); Wimalanathan Kokulapalan, Cambridge, MA (US)

(73) Assignees: GREENLIGHT BIOSCIENCES, INC., Lexington, MA (US); UNITED STATES, AS REPRESENTED BY THE SECRETARY OF AGRICULTURE, Beltsville, MD (US)

( * ) Notice: Subject to any disclaimer, the term of this patent is extended or adjusted under 35 U.S.C. 154(b) by 0 days.

(21) Appl. No.: 17/689,598

(22) Filed: Mar. 8, 2022

(65) Prior Publication Data

US 2022/0290170 A1 Sep. 15, 2022

Related U.S. Application Data

(60) Provisional application No. 63/158,293, filed on Mar. 8, 2021.

(51) Int. Cl.
*C12N 15/82* (2006.01)
*C12N 15/113* (2010.01)

(52) U.S. Cl.
CPC ........ *C12N 15/8218* (2013.01); *C12N 15/113* (2013.01); *C12N 15/8286* (2013.01)

(58) Field of Classification Search
CPC .................................................. C12N 15/8218
USPC ......................................................... 800/279
See application file for complete search history.

(56) References Cited

U.S. PATENT DOCUMENTS

| | | |
|---|---|---|
| 7,655,785 B1 | 2/2010 | Bentwich |
| 7,687,616 B1 | 3/2010 | Bentwich et al. |
| 7,777,022 B2 | 8/2010 | Bentwich et al. |
| 7,812,002 B2 | 10/2010 | Feinstein |
| 7,888,497 B2 | 2/2011 | Bentwich et al. |
| 7,943,754 B2 | 5/2011 | Bentwich et al. |
| 8,178,503 B2 | 5/2012 | Rigoutsos et al. |
| 8,278,287 B2 | 10/2012 | Feinstein et al. |
| 8,410,069 B2 | 4/2013 | Feinstein |
| 9,932,579 B2 | 4/2018 | Paldi et al. |
| 10,301,643 B2 | 5/2019 | Abad et al. |
| 10,557,138 B2 | 2/2020 | Gleit-Kielmanowicz et al. |
| 10,801,028 B2 | 10/2020 | Sela et al. |
| 10,858,385 B2 | 12/2020 | Cunningham et al. |
| 10,888,579 B2 | 1/2021 | Paldi et al. |
| 10,907,152 B2 | 2/2021 | Inberg et al. |
| 10,927,374 B2 | 2/2021 | Inberg et al. |
| 10,954,541 B2 | 3/2021 | Blake et al. |
| 11,142,768 B2 | 10/2021 | Barros Rodrigues et al. |
| 11,185,079 B2 | 11/2021 | Barros Rodrigues et al. |
| 11,274,284 B2 | 3/2022 | Blake et al. |
| 2016/0215290 A1* | 7/2016 | Kogel ................ C12N 15/1137 |
| 2016/0272993 A1 | 9/2016 | Abad et al. |
| 2018/0320179 A1* | 11/2018 | Delgado ............. C12N 15/8282 |
| 2021/0068402 A1 | 3/2021 | Inderg et al. |

FOREIGN PATENT DOCUMENTS

| | | |
|---|---|---|
| EP | 3019609 B1 | 7/2014 |
| EP | 3431601 A3 | 7/2014 |
| WO | 2006126040 A1 | 11/2006 |
| WO | 201510026 A1 | 7/2015 |
| WO | 2020081486 A1 | 4/2020 |
| WO | 2020081487 A1 | 4/2020 |
| WO | 2020123419 A2 | 6/2020 |
| WO | 2021032334 A1 | 2/2021 |
| WO | 2021113774 A1 | 6/2021 |
| WO | 2021231791 A2 | 11/2021 |

OTHER PUBLICATIONS

Rallos et al. Plos One DOI:10.1371 p. 1-18 (Year: 2016).*
Ahmed, Ali Abdurehim et al., "The Barley Powdery Mildew Effector Candidates CSEP0081 and CSEP0254 Promote Fungal Infection Success", PLos One, 2016, vol. 11, No. 6, 12 pages.
Angelini, Rita Milvia De Miccolis et al., "Transcriptome sequence resource for the cucurbit powdery mildew pathogen *Podosphaera xanthii*", Scientific Date, 2019, vol. 6, No. 95, 12 pages.
Barnett, Mariam "Computational identification of conserved haustorial-expressed genes in the grapevine powdery mildew fungus *Erysiphe necator*", Thesis. The Rochester Institute of Technology, 2015, 55 pages.
Bierman, Andrew et al., "A High-Throughput Phenotyping System Using Machine Vision to Quantify Severity of Grapevine Powdery Mildew", Plant Phenomics, 2019, vol. 2019, Article 9209727, 13 pages.

(Continued)

*Primary Examiner* — Li Zheng
(74) *Attorney, Agent, or Firm* — Timothy H. Van Dyke; WOLTER, VAN DYKE, DAVIS, PLLC

(57) ABSTRACT

Disclosed herein are compositions and methods that involve recombinant polynucleotide molecules, such as single or double-stranded DNA or RNA molecules, also referred to "triggers", that are useful for controlling or preventing *E. necator* infection, or recombinant DNA constructs for making such RNA molecules or for making transgenic grape plants resistant to *E. necator* infection. In some embodiments, polynucleotide triggers are provided as topically applied agents for controlling or preventing infection of a plant by *E. necator*.

12 Claims, 5 Drawing Sheets

Specification includes a Sequence Listing.

(56) References Cited

OTHER PUBLICATIONS

Braun, Uwe et al., New records and new host plants of powdery mildews (*Erysiphales*) from Idaho and Oregon (USA), Schlechtendalia, 2013, vol. 27, pp. 7-10.
Break-Thru, Technical Information Break-Thru S 240, Feb. 2020, 2 pages.
Brewer, Marin Talbot et al., "Phylogeography and population structure of the grape powdery mildew fungus, *Erysiphe necator*, from diverse *Vitis* species", Brewer and Milgroom BMC Evolutionary Biology, 2010, vol. 10, No. 268, 13 pages.
Cadle-Davidson, Lance et al., "Specific Isolation of RNA from the Grape Powdery Mildew Pathogen *Erysiphe necator*, an Epiphytic, Obligate Parasite", Journal of Phytopathology, Dec. 2010, vol. 158, No. 69, pp. 69-71.
Cagliari, Deise et al., "Management of Pest Insects and Plant Diseases by Non-Transformative RNAi", Front. Plant Sci., 2019, vol. 10, No. 1319, 18 pages.
Colcol, Jeneylyne F., "Fungicide Sensitivity of Erysiphe necator and Plasmopara viticola from Virginia and nearby states", Master of Science Plant Pathology, Physiology and Weed Science Plant Pathology option, Aug. 1, 2008, 72 pages.
Csikos, Anett et al., "A Fresh Look at Grape Powdery Mildew (*Erysiphe necator*) A and B Genotypes Revealed Frequent Mixed Infections and Only B Genotypes in Flag Shoot Samples", Plants, Sep. 2020, vol. 9, No. 1156, 12 pages.
Delye, Christophe et al., "A Mutation in the 14x-Demethylase Gene of Uncinula necator That Correlates with Resistance to a Sterol Biosynthesis Inhibitor", Applied and Environmental Microbiology, Aug. 1997, vol. 63, No. 8, pp. 2966-2970.
Feng, Xuewen et al., "Evaluation of Quinoxyfen Resistance of *Erysiphe necator* (Grape Powdery Mildew) in a Single Virginia Vineyard", Plant Disease, 2018, vol. 102, No. 12, pp. 2586-2591.
FRAC, "FRAC Code List 1: Fungicides sorted by FRAC Code", Dec. 2005, 8 pages.
FRAC, FRAC Code List 1: Fungicides sorted by mode of action (including FRAC Code numbering), Dec. 2009, 10 pages.
Frenkel, Omer et al., "Mechanisms of Resistance to an Azole Fungicide in the Grapevine Powdery Mildew Fungus, *Ersiphe necator*", Phytopathology, 2015, vol. 105, No. 3, pp. 370-377.
Alcazar-Fuoli, Laura et al., "Ergosterol biosynthesis pathway in Aspergillus fumigatus", Steriods, 2008, vol. 73, pp. 339-347.
Gadoury, David M. et al., "Grapevine powdery mildew (*Erysiphe necator*): a fascinating system for the study of the biology, ecology and epidemiology of an obligate biotroph", Molecular Plant Pathology, 2012, vol. 13, No. 1, pp. 1-16.
Gaforio, L. et al., "Evaluation of susceptibility to powdery mildew (*Erysiphe necator*) in Vitis vinifera varieties", Vitis, 2011, vol. 50, No. 3, pp. 123-126.
Haile, Zeraye Mehari et al., "Double-Stranded RNA Targeting Dicer-Like Genes Compromises the Pathogenicity of Plasmopara viticola on Grapevine", Frontiers in Plant Science, May 2021, vol. 12, article 667539.
Han, Lijuan et al., "Identification and Characterization of Erysiphe necator-Responsive MicroRNAs in Chinese Wild Vitis pseudoreticulata by High-Throughput Sequencing", Frontiers in Plant Science, May 2016, vol. 7, article 621, 14 pages.
Jones, Laura et al., "Adaptive genomic structural variation in the grape powdery mildew pathogen, *Erysiphe necator*", BMC Genomics, 2014, vol. 15, No. 1081, 17 pages.
Koch, Aline et al., "An RNAi-Based Control of Fusarium graminearum Infections Through Spraying of Long dsRNAs Involves a Plant Passage and Is Controlled by the Fungal Silencing Machinery", PLOS Pathogens, Oct. 13, 2016, 22 pages.
Lin, Ke et al., "Deep Learning-Based Segmentation and Quantification of Cucumber Powdery Mildew Using Convolutional Neural Network", Frontiers in Plant Science, Feb. 2019, vol. 10, article 155, 10 pages.
NCSFR, Northwest Center for Small Fruits Research 2020 Virtual Conference, 2020 Proceedings of the Northwest Center for Small Fruits Research, Dec. 14-16, 2020, 35 pages.
Oiv, 2019 Statistical Report on World Vitivinculture, 2018, 23 pages.
Parker, Josie E. et al., Resistance to antifungals that target CYP51, J Chem Biol, 2014, vol. 7, pp. 143-161.
PCT/EP2014/064484, PCT Report & Written Opinion mailed Sep. 24, 2014, 11 pages.
Polonio, Alvaro et al., "The haustorial transcriptome of the cucurbit pathogen *Podosphaera xanthii* reveals new insights into the biotrophy and pathogenesis of powdery mildew fungi", BMC Genomics, 2019, vol. 20, No. 543, 18 pages.
Qiu, Wenping et al., "Current understanding of grapevine defense mechanisms against the biotrophic fungus (*Erysiphe necator*), the causal agent of powdery mildew disease", Horticulture Research, 2015, vol. 2, 9 pages.
Rallos, Lynn Ester E. et al., "Co-Occurrence of Two Allelic Variants of CYP51 in Erysiphe necator and Their Correlation with Over-Expression for DMI Resistance", Plos One, Feb. 3, 2016, vol. 11, No. 2, 18 pages.
Sambucci, Olena et al., "The Pecuniary and Nonpecuniary Costs of Powdery Mildew and the Potential Value of Resistance Grape Varieties in California", Am J Enol Vitic., Apr. 2019, vol. 70, pp. 177-187, Abstract Only.
Toruno, Tania Y. et al., "Plant Pathogen Effectors: Cellular Probes Interfering with Plant Defenses in a Spatial and Temporal Manner", Annu. Rev. Phytopathol., 2016, vol. 54, No. pp. 18.1-18.23.
Vielba-Fernández, Alejandra et al., "Fungicide Resistance in Powdery Mildew Fungi", Microorganisms, 2020, vol. 8, No. 1431, 34 pages.
Wakefield, Laura et al., "Differential Gene Expression During Conidiation in the Grape Powdery Mildew Pathogen, *Erysiphe necator*", Phytopathology, Mar. 2011, vol. 101, pp. 839-846.
Warneke, Brent W. et al., "Grape Powdery Mildew Management: The Interaction Between Inflorescence Stage and Fungicide Chemistry", An Abstract of the Thesis, Mar. 7, 2018.
Wilcox, Wayne F., "Grapevine Powdery Mildew", Cornell Cooperative Extension, 2003, 3 pages.
Yin, Ling et al., "Genome sequence of Plasmopara viticola and insight into the pathogenic mechanism", Scientific Reports, Apr. 18, 2017, vol. 7, 12 pages.
Zhang, Jingxiang et al., "The Fungal CYP51s: Their Functions, Structures, Related Drug Resistance, and Inhibitors", Front. Microbiol., Apr. 24, 2019, vol. 10, article 691, 17 pages.
Gebremichael, Daniel Endale et al., "RNA Interference Strategies for Future Management of Plant Pathogenic Fungi: Prospects and Challenges", Plants, 2021, vol. 10, No. 650, 21 pages.
Höfle, L. et al., "Study on the efficiency of dsRNAs with increasing length in RNA-based silencing of the Fusarium CYP51 genes", RNA Biology, 2020, vol. 17, No. 4, pp. 463-473.
Kalyandurg, Pruthvi B. et al., "Spray-Induced Gene Silencing as a Potential Tool to Control Potato Late Blight Disease", Phytopathology®, 2021, vol. 111, pp. 2168-2175.
Knorr, Eileen et al., "Gene silencing in Tribolium castaneum as a tool for the targeted identification of candidate RNAi targets in crop pests", Scientific Reports, 2018, vol. 8, No. 2061, 15 pages.
Qiao, Lula et al., "Spray-induced gene silencing for disease control is dependent on the efficiency of pathogen RNA uptake", Plant Biotechnology Journal, 2021, vol. 19, pp. 1756-1768.
Rodrigues, Thais B. et al., "Identification of highly effective target genes for RNAi-mediated control of emerald ash porer, Agrilus planipennis", Scientific reports, 2018, vol. 8, No. 5020, 9 pages.
Li, H. et al., "Long dsRNA but not siRNA initiates RNAi in western corn rootworm larvae and adults", J. Appl. Entomol., 2015, vol. 139, pp. 432-445.
Genbank, "Erysiphe necator cytochrome P450 sterol 14-alpha demethylase (CYP51) gene, CYP51-resistant allele, complete cds", www.ncbi.nlm.nih.gov, downloaded from Internet Jul. 12, 2022, 2 pages.
Genbank, "Erysiphe necator strain Pumocnh cytochrome P450 sterol 14-alpha demethylase (CYP51) gene, complete cds", www.ncbi.nlm.nih.gov, downloaded from Internet Jul. 12, 2022, 2 pages.

(56) References Cited

OTHER PUBLICATIONS

Genbank, "Erysiphe necator eburicol 14-alpha demethylase (CYP51) gene, complete cds", www.ncbi.nlm.nih.gov, downloaded from Internet Jul. 12, 2022, 2 pages.
PCT search report & written opinion, PCT/US2022/19320, mailed Aug. 30, 2022, 15 pages.
Berger, Imre et al., "Baculovirus expression system for heterologous multiprotein complexes", Nature Biotechnology, Dec. 2004, vol. 22, No. 12, pp. 1583-1590.

* cited by examiner

RNA-BASED CONTROL OF POWDERY MILDEW

RELATED APPLICATIONS

This application claims the benefit under 35 U.S.C. § 119(e) of U.S. provisional application No. 63/158,293 filed on Mar. 8, 2021, which is incorporated by reference herein in its entirety.

BACKGROUND

Grape powdery mildew, caused by *Erysiphe necator* (*E. necator*) Syn *Uncinula necator*, is the most significant disease in terms of expenses for control and losses in quality and yield encountered by grape growers worldwide. For example, powdery mildew management accounts for 74% of total pesticide applications by California grape growers and 17% of total pesticides used in California Agriculture (by weight of active ingredient). In California, the statewide cost of powdery mildew management in 2015 was approximately $239 million, including the costs of pesticide materials and application (Sambucci et al., 2019). *E. necator* is considered to be a high-risk pathogen due to its ability to develop resistance to fungicides from multiple chemical groups (i.e. sterol demethylation inhibitors, quinone outside inhibitors and succinate dehydrogenase inhibitors) within a few years (Vielba-Femandez et al. 2020). Fungal resistance to fungicides is a challenge in grape protection, and current practices heavily rely on the chemical treatments which are harmful to the environment and detrimental to human health. Therefore, the development of alternative, sustainable and environmental methods to control *E. necator* is an urgent task. Currently, several studies have shown that it is possible to silence essential genes for the control of pathogens via RNA interference without adversely affecting non-target species, allowing growers to target pests more precisely and in an environmentally friendly manner compared to conventional agrochemicals (Cagliari et al. 2019).

To address these issues, the present invention is directed to, inter alia, topically applied double-stranded (ds)RNA that selectively decrease or eliminate *E. necator* growth when sprayed on grapevine leaves.

SUMMARY

RNA interference (RNAi) technology has been shown to be a highly selective biological treatment silencing gene expression of pests and pathogens through internal biological processes. Exogenous application of double-stranded RNA (dsRNA), which initiates RNAi, has been used to effectively control certain plant pest species. The present disclosure is directed to an approach using dsRNA to control the fungal pathogen, *E. necator*. In particular embodiments, methods and compositions are described to provide *E. necator* control by using exogenous dsRNA application administered to grapevine leaves.

The compositions and methods described herein include recombinant polynucleotide molecules, such as single or double-stranded DNA or RNA molecules, referred to herein as "triggers", that are useful for controlling or preventing *E. necator* infection, or recombinant DNA constructs for making such RNA molecules or for making transgenic grape plants resistant to *E. necator* infection. In some embodiments, polynucleotide triggers are provided as topically applied agents for controlling or preventing infection of a plant by *E. necator*. In some embodiments, grape plants with improved resistance to infection by *E. necator*, such as transgenic grape plants (including seeds or propagatable parts) expressing a polynucleotide trigger are provided. In some embodiments, grape plants (including seeds or propagatable parts) that have been topically treated with a composition comprising a polynucleotide trigger (e.g., grape plants that have been sprayed with a solution of dsRNA molecules) are provided. Also provided are polynucleotide-containing compositions that are topically applied to a *E. necator* or to a plant, plant part, or seed to be protected from infection by *E. necator*.

Several embodiments relate to suppression of a target gene in *E. necator* by a polynucleotide trigger. Provided herein are nucleotide sequences referred to herein as the "Target Gene Sequence Groups", which consists of SEQ ID NOs: 1-107, 429-642. Certain embodiments of the inventions relate to polynucleotides designed to hybridize to RNA transcripts of the target genes resulting in RNAi. Also provided are nucleotide sequences referred to herein as the "Trigger Sequences Group" or the "Trigger Sequences", which consists of SEQ ID Nos:108-214, 643-856. Further provided herein are the "RNA Trigger Sequences Group" or "RNA Trigger Sequences", which consist of SEQ ID Nos: 215-321, 857-1070. The RNA Trigger Sequences Group are identical to the Trigger Sequences Group, except for replacing thymine with uracil. Reverse complements to the RNA Trigger Sequences Group are also provided herein, referred to as "RNA Trigger Sequence Reverse Complements Group" or the RNA Trigger Sequence Reverse Complements", consisting of SEQ ID Nos: 322-428, 1071-1284.

The RNA Trigger Sequences Reverse Complement Group are the perfect complements to sequences in the RNA Trigger Sequence Group read from 5' to 3'. The RNA Trigger Sequence Groups were designed according to the corresponding mRNA transcripts of the Target Gene Sequences to affect RNAi on such transcripts, preventing or decreasing translation of the relevant proteins. Tables 1A and 1B provided herein match the various Gene Target Sequences to their corresponding Trigger Sequences, RNA Trigger Sequences, and RNA Trigger Reverse Complement Sequences. The SEQ ID NOs relate to the sequences provided in SEQ ID listing provided in the tables and in Appendix A submitted herewith.

In one aspect, a method for controlling *E. necator* infection of a plant comprising contacting *E. necator* with a polynucleotide comprising at least one segment of 18 or more contiguous nucleotides with a sequence of about 95% to about 100% identity (e.g., a segment of 21 contiguous nucleotides with a sequence of 100% identity would be included) with a corresponding fragment of a DNA having a sequence selected from the group consisting of: the Target Gene Sequences Group, or the DNA complement thereof. In an embodiment, the method for controlling *E. necator* infection of a plant comprises contacting *E. necator* with a polynucleotide comprising a nucleotide sequence that is complementary to at least 18 contiguous nucleotides of a target gene having a nucleotide sequence selected from the group consisting of SEQ ID NOs:1-107, 429-642 or in a specific embodiment SEQ ID NO:1 or in other embodiments, SEQ ID NOs: 2, 32, 35, 37, 61, 67, 74, 85, 88, 106, 555, or 614, or an RNA transcribed from the target gene. In some embodiments, the polynucleotide comprises a sequence complementary to or about 95% to about 100% identical to at least 18 contiguous nucleotides of a sequence selected from the group consisting of SEQ ID NOs: 215-321, and 857-1070 or SEQ ID Nos: 322-428 and 1071-1284. In some embodiments the polynucleotide is designed to have complementarity to a mRNA encoded for by a target gene. In some embodiments, the polynucleotide is double-stranded RNA. In some embodiments, the polynucleotide comprises one or more nucleotide sequences selected from the Trigger Sequences Group, the RNA Trigger Sequence Group or the RNA Trigger Sequences Reverse Complement Group or more specifically, selected from SEQ ID. NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the contacting with a polynucleotide is achieved by topical application of the polynucleotide, or of a composition or solution containing the polynucleotide (e.g., by spraying or dusting or soaking), directly to *E. necator* or to a surface or matrix (e.g., a plant or soil) contacted by *E. necator*. In some embodiments, the topical application of the polynucleotide or a composition or solution containing the polynucleotide is achieved by spraying the polynucleotide or the composition or solution containing the polynucleotide onto leaves of *Vitis vinifera*, *Vitis* interspecific hybrid, or a variety thereof, that are infected or may become infected by *E. necator*. In some embodiments, the contact with a polynucleotide is achieved by providing a transgenic plant that expresses the sequence to control *E. necator* infection.

Several embodiments relate to a method for controlling *E. necator* infection of a plant by providing exposure of *E. necator* to a composition comprising an agent and a polynucleotide having at least one segment of 18 or more contiguous nucleotides with a sequence of about 95% to about 100% identity (e.g., a segment of 21 contiguous nucleotides with a sequence of 100% identity) with a corresponding fragment of DNA having a sequence selected from the group consisting of: the Target Gene Sequences Group, or the DNA complement thereof, and wherein the agent functions upon contact or intake (e.g. absorb internally/transfection) by *E. necator* to inhibit a biological function within *E. necator* thereby controlling infection by *E. necator*. In some embodiments, the polynucleotide comprises one or more nucleotide sequences selected from the Trigger Sequences Group, the RNA Trigger Sequences Group, or the RNA Trigger Sequence Reverse Complement Group or the polynucleotide comprises one or more nucleotide sequences about 95% to about 100% identical to one or more nucleotide sequences selected from the Trigger Sequences Group, the RNA Trigger Sequences Group, or the RNA Trigger Sequences Reverse Complement Group. In some embodiments, the polynucleotide is double-stranded RNA.

In some embodiments the agent comprises
(a) fungicidally effective amount of a polynucleotide comprising at least 18, 19, 20, 21, 25, 50, 100, 150, 200, 250, 300, 350, 400, or 450 contiguous nucleotides that are complementary to or comprises at least about 85%, at least about 90%, at least about 95%, at least about 98%, about 100%, or 100% sequence identity with a segment of a target gene having a nucleotide sequence selected from the group consisting of: SEQ ID NOs: 1-107 and 429-642, or an RNA transcribed from said target gene;
(b) a fungicidally effective amount of at least one polynucleotide comprising at least one silencing element that is complementary to, or comprises at least about 85%, at least about 90%, at least about or 95% sequence identity with, at least 18, 19, 20, 21, 25, 50, 100, 150, 200, 250, 300, 350, 400, or 450 contiguous nucleotides of a target gene or an RNA transcribed from said target gene, wherein said target gene has a nucleotide sequence selected from the group consisting of: SEQ ID NOs: 1-107 and 429-642;
(c) a fungicidally effective amount of at least one RNA comprising at least one segment that is complementary to, or comprises at least about 85%, at least about 90%, at least about 95%, at least about 98%, about 100%, or 100% sequence identity with, at least 18, 19, 20, 21, 25, 50, 100, 150, 200, 250, 300, 350, 400, or 450 contiguous nucleotides of a segment of a target gene having a nucleotide sequence selected from the group consisting of: SEQ ID NOs: 1-107 and 429-642, or an RNA transcribed from said target gene; or
(d) an RNA molecule that causes mortality, suppression of growth, or decrease in propagation/reproductive capacity in *E. necator* when transfected to or contacted by said *E. necator*, wherein said RNA molecule comprises at least 18, 19, 20, 21, 25, 50, 100, 150, 200, 250, 300, 350, 400, or 450 contiguous nucleotides that are complementary to, or comprise at least about 85%, at least about 90%, at least about 95%, at least about 98% or about 100% or 100% sequence identity with, a segment of a target gene having a nucleotide sequence selected from the group consisting of: SEQ ID NOs: 1-107 and 429-642, or an RNA transcribed from said target gene; or
(e) a double-stranded RNA molecule that causes mortality, suppression of growth, or decrease in propagation/reproductive capacity in *E. necator* when transfected or contacted to said *E. necator*, wherein at least one strand of said double-stranded RNA molecule comprises at least 18, 19, 20, 21, 25, 50, 100, 150, 200, 250, 300, 350, 400, or 450 contiguous nucleotides that are complementary to, or comprise at least 85%, 90% 95%, 98%, or 100% sequence identity with, a segment of a target gene or an RNA transcribed from said target gene, wherein said target gene has a sequence selected from the group consisting of: SEQ ID NOs: 1-107 and 429-642; or
(f) a fungicidally effective amount of at least one double-stranded RNA comprising at least one strand that comprises a sequence selected from the group consisting of: SEQ ID NOs: 108-214, 643-856, 215-321, 857-1070, 322-428, and 1071-1284, or a sequence having at least about 85%, at least about 90%, at least about 95%, at least about 98%, about 100%, or 100% sequence identity therewith; or
(g) a fungicidally effective amount of a polynucleotide comprising at least 18, 19, 20, 21, 25, 50, 100, 150, 200, 250, 300, 350, 400, or 450 contiguous nucleotides of a nucleotide sequence selected from the group consisting of: SEQ ID NOs: 108-214, 643-856, 215-321, 857-1070, 322-428, and 1071-1284, or a sequence having at least about 85%, at least about 90%, at least about 95%, at least about 98%, or about 100% sequence identity therewith; or
(h) a fungicidally effective amount of at least one RNA comprising at least one segment that is complementary to, or comprises at least about 85%, at least about 90%, at least about 95%, at least about 98%, about 100%, or 100% sequence identity with, at least 18, 19, 20, 21, 25, 50, 100, 150, 200, 250, 300, 350, 400, or 450 contiguous nucleotides of a nucleotide sequence selected from the group consisting of: SEQ ID NOs: 108-214, 643-856, 215-321, 857-1070, 322-428, and 1071-1284; or
(i) an RNA molecule that causes mortality, suppression of growth, or decrease in reproductive/propagation capacity in *E. necator* when transfected to or contacted by said *E. necator*, wherein said RNA molecule comprises at least 18, 19, 20, 21, 25, 50, 100, 150, 200, 250, 300, 350, 400, or 450 contiguous nucleotides that are complementary to, or comprise at least at least about 85%, at least about 90%, at least about 95%, at least about 98%, about 100%, or 100% sequence identity with a segment of a nucleotide sequence selected from the group consisting of: SEQ ID NOs: 108-214, 643-856, 215-321, 857-1070, 322-428, and 1071-1284; or (j) a double-stranded RNA molecule that causes mortality, suppression of growth, or decrease in reproductive/propagation capacity in *E. necator* when transfected or contacted to said *E. necator*, wherein at least one strand of said fungicidal double-stranded RNA molecule comprises at least 18, 19, 20, 21, 25, 50, 100, 150, 200, 250, 300, 350, 400, or 450 contiguous nucleotides that are complementary to, or comprise at least about 85%, at least about 90%, at least about 95%, at least about 98%, about 100%, or 100% sequence identity with, a segment of a nucleotide sequence selected from the group consisting of: SEQ ID NOs: 108-214, 643-856, 215-321, 857-1070, 322-428, and 1071-1284;

(k) a fungicidal double-stranded RNA molecule that causes mortality, suppression of growth, or decrease in reproductive/propagation capacity in *E. necator* when transfected or contacted to said *E. necator*, wherein at least one strand of said fungicidal double-stranded RNA molecule comprises at least about 85%, at least about 90%, at least about 95%, at least about 98%, about 100%, or 100% sequence identity with, a nucleotide sequence selected from the group consisting of: SEQ ID NOs: 108-214, 643-856, 215-321, 857-1070, 322-428, and 1071-1284.

In certain embodiments, the agent containing the polynucleotide is formulated for application to fields of plants, e.g., in sprayable solutions or emulsions, tank mixes, or powders. In some embodiments, the agent is biologically produced, e.g., in the form of a microbial fermentation product or expressed in a transgenic plant cell.

Any suitable DNA encoding RNAi molecules targeting the target genes described herein may be used in the compositions and methods described herein. A DNA may be a single-stranded DNA (ssDNA) or a double-stranded DNA (dsDNA). In some embodiments, a DNA comprises one or more DNA expression cassette(s) that when transcribed produces a single stranded RNA (ssRNA) molecule (e.g., that remains single stranded or folds into an RNA hairpin) or complementary ssRNA molecules that anneal to produce the double stranded RNA (dsRNA) molecule.

Several embodiments relate to a method of providing a plant having improved resistance to *E. necator* infection comprising topical application to the plant of a composition comprising at least one polynucleotide having at least one segment of 18 or more contiguous nucleotides with a sequence of about 95% to about 100% identity (e.g., a segment of 21 contiguous nucleotides with a sequence of 100% identity) with a corresponding fragment of DNA having a sequence selected from the group consisting of: the Target Gene Sequences Group, or the DNA complement thereof. In an embodiment, the method of providing a plant having improved resistance to *E. necator* infection comprises topical application to the plant of a composition comprising at least one polynucleotide comprising a nucleotide sequence that is complementary to at least 18 contiguous nucleotides of a target gene having a nucleotide sequence selected from the group consisting of SEQ ID NOs:1-107, 429-642, or more specifically selected from the group consisting of SEQ ID Nos: 1, 2, 32, 35, 37, 61, 67, 74, 85, 88, 106, 555, 614, or in a specific embodiment SEQ ID NO: 1, or an RNA transcribed from the target gene. In some embodiments the at least one polynucleotide comprises the RNA Trigger Sequences or the RNA Trigger Sequence Reverse Complements or comprises a nucleotide sequence at least about 75% or at least about 80% or at least about 85% or at least about 90% or at least about 95% or at least about 98% or about 100% or 100% identical to the RNA Trigger Sequences or the RNA Trigger Sequence Reverse Complements. In some embodiments the polynucleotide is dsRNA comprising one or more sequences selected from the RNA Trigger Sequences and a corresponding sequence selected from the RNA Trigger Sequence Reverse Complements. In an embodiment, the method of providing a plant having improved resistance to *E. necator* infection comprises topical application to the plant of a composition comprising at least one polynucleotide in a manner such that an effective amount of the polynucleotide is transfected into or contacted by *E. necator* infecting the plant, the polynucleotide comprising at least 18 contiguous nucleotides that are complementary to a portion of a target gene having a nucleotide sequence selected from the group consisting of SEQ ID Nos:1-107 and 429-642 or an RNA transcribed from the target gene. In some embodiments, the polynucleotide comprises one or more nucleotide sequences selected from the Trigger Sequences Group, the RNA Trigger Sequences Group, or the RNA Trigger Sequences Reverse Complement Group or comprises nucleotide sequences at least about 75% or at least about 80% or at least about 85% or at least about 90% or at least about 95% or at least about 98% identical to the RNA Trigger Sequences or the RNA Trigger Sequence Reverse Complements. In some embodiments the polynucleotide is dsRNA comprising one or more sequences selected from the RNA Trigger Sequences and a corresponding sequence selected from the RNA Trigger Sequence Reverse Complements. In some embodiments, the polynucleotide is dsRNA. Several embodiments relate to compositions comprising the polynucleotide, formulated for application to fields of grape plants, e.g., in sprayable solutions or emulsions, tank mixes, or powders.

Several embodiments relate to a fungicidal composition for controlling *E. necator* comprising a fungicidally effective amount of at least one polynucleotide molecule comprising at least one segment of 18 or more contiguous nucleotides that are essentially identical or complementary (e.g., a segment of 21 contiguous nucleotides with a sequence of 100% identity or complementarity) with the corresponding fragment of DNA having a sequence selected from the group consisting of: the Target Gene Sequences Group, or the DNA complement thereof. In some embodiments, the polynucleotide molecule comprises at least 18 contiguous nucleotides that are complementary to a portion of a target gene having a nucleotide sequence selected from the group consisting of: SEQ ID Nos:1-107, or, more specifically, selected from the group consisting of SEQ ID Nos: 1, 2, 32, 35, 37, 61, 67, 74, 85, 88, 106, 555, 614, or in a specific embodiment SEQ ID NO:1, or an RNA transcribed from the target gene. In some embodiments, the polynucleotide comprises one or more nucleotide sequences selected from the Trigger Sequences Group, the RNA Trigger Sequences Group, or the RNA Trigger Sequence Reverse Complements Trigger or comprises nucleotide sequences complementary to or at least about 75% or at least about 80% or at least about 85% or at least about 90% or at least about 95% or at least about 98% or about 100% or 100% identical to nucleotide sequences selected from the Trigger Sequences Group, the RNA Trigger Sequences or the RNA Trigger Sequence Reverse Complements. In some embodiments the polynucleotide is dsRNA comprising one or more sequences selected from the RNA Trigger Sequences and a corresponding sequence selected from the RNA Trigger Sequence Reverse Complements. In some embodiments, the polynucleotide molecule is a recombinant polynucleotide. In some embodiments, the polynucleotide molecule is RNA. In some embodiments, the polynucleotide molecule is dsRNA. Related embodiments include fungicidal compositions comprising the polynucleotide molecule formulated for application to fields of grape plants, e.g., in sprayable solutions or emulsions, tank mixes, or powders, and optionally comprising one or more additional components, such as a carrier agent, a surfactant, an organosilicone, an organosilicone surfactant, a polynucleotide herbicidal molecule, a non-polynucleotide herbicidal molecule, a polynucleotide pesticide, a non-polynucleotide pesticide, a polynucleotide fungicide, a non-polynucleotide fungicide, a polynucleotide insecticide, a non-polynucleotide insecticide, a safener, and a pathogen growth regulator.

Several embodiments relate to a method of providing a plant having improved resistance to E. necator infection comprising expressing in the plant at least one polynucleotide comprising at least one segment of 18 or more contiguous nucleotides that are essentially identical or complementary to (e.g., a segment of 21 contiguous nucleotides with a sequence of 100% identity or complementarity with) the corresponding fragment of DNA having a sequence selected from the group consisting of: the Target Gene Sequences Group, or the DNA complement thereof. In some embodiments, the polynucleotide comprises one or more nucleotide sequences selected from the Trigger Sequences Group, the RNA Trigger Sequences Group, or the RNA Trigger Sequences Reverse Complement Group or comprises nucleotide sequences at least about 75% or at least about 80% or at least about 85% or at least about 90% or at least about 95% or at least about 98% identical to a sequence selected from RNA Trigger Sequences or the RNA Trigger Sequence Reverse Complements. In some embodiments, the polynucleotide is dsRNA comprising one or more sequences selected from the RNA Trigger Sequences and a corresponding sequence selected from the RNA Trigger Sequence Reverse Complements.

Several embodiments relate to a recombinant DNA construct comprising a heterologous promoter operably linked to a DNA element comprising at least one segment of 18 or more contiguous nucleotides with a sequence of about 95% to about 100% identity (e.g., a segment of 21 contiguous nucleotides with a sequence of 100% identity) with the corresponding fragment of DNA having a sequence selected from the group consisting of: the Target Gene Sequences Group, or the DNA complement thereof. In some embodiments, the DNA element encodes a double-stranded RNA. In some embodiments, the double-stranded RNA comprises one or more nucleotide sequences selected from the Trigger Sequences Group, RNA Trigger Sequences Group, or RNA Trigger Sequences Reverse Complement Group. Related embodiments include a plant chromosome or a plastid or a recombinant plant virus vector or a recombinant baculovirus vector comprising the recombinant DNA construct, or comprising the DNA element without the heterologous promoter.

Several embodiments relate to a transgenic grape plant cell having in its genome a recombinant DNA encoding RNA that suppresses expression of a target gene in E. necator that contacts or is transfected with the RNA, wherein the RNA comprises at least one silencing element having at least one segment of 18 or more contiguous nucleotides complementary to a fragment of a target gene. In some embodiments, the target gene is selected from the Target Gene Sequences Group. A specific embodiment is a transgenic grape plant cell having in its genome a recombinant DNA encoding RNA for silencing one or more target genes selected from the Target Gene Sequences Group. In some embodiments, the RNA comprises one or more nucleotide sequences selected from the Trigger Sequences Group, RNA Trigger Sequences Group, or RNA Trigger Sequences Reverse Complement Group or comprises nucleotide sequences at least about 75% or at least about 80% or at least about 85% or at least about 90% or at least about 95% or at least about 98% or about 100% or 100% identical to a sequence selected from the RNA Trigger Sequences or the RNA Trigger Sequence Reverse Complements.

Several embodiments relate to an isolated recombinant RNA molecule that causes mortality, suppression of growth, a decrease in virulence or pathogenicity, or decrease in propagation/reproduction capacity (sporulation) of E. necator when transfected with or contacted by E. necator on v. vinifera, wherein the recombinant RNA molecule comprises at least one segment of 18 or more contiguous nucleotides that are essentially complementary to (e.g., a segment of 21 contiguous nucleotides with a sequence of 100% complementarity with) the corresponding fragment of DNA having a sequence selected from the group consisting of: the Target Gene Sequences Group, or the DNA complement thereof. In some embodiments, the recombinant RNA molecule is double-stranded RNA. Specific embodiments include an isolated recombinant double-stranded RNA molecule with a strand having a sequence selected from the group consisting of SEQ ID Nos: 108-214, 643-856, 215-321, 857-1070, 322-428, and 1071-1284 or a combination thereof. Another embodiment pertains to an isolated recombinant double-stranded RNA molecule with a strand having a sequence SEQ ID NO: 108 or SEQ ID NO: 215 or SEQ ID NO: 322. Other embodiments pertain to an isolated recominbindant double-stranded RNA molecule with a strand having a sequence selected from the groups consisting of SEQ ID NO: 109, 139, 142, 144, 168, 174, 181, 192, 195, 213, 769, 828, 216, 246, 249, 251, 275, 281, 288, 299, 302, 320, 983, 1042, 323, 353, 356, 358, 382, 388, 395, 406, 409, 427, 1197, and 1256.

Several embodiments relate to a method of providing a plant having improved resistance to E. necator infection comprising providing to the plant at least one polynucleotide comprising at least one segment of 18 or more contiguous nucleotides that are essentially identical or complementary to (e.g., a segment of 21 contiguous nucleotides with a sequence of 100% identity or complementarity with) the corresponding fragment of a target gene selected from the Target Gene Sequences Group. In an embodiment, the method of providing a plant having improved resistance to E. necator infection comprises providing to the plant at least one polynucleotide comprising at least one segment that is identical or complementary to at least 18 contiguous nucleotides of a target gene or an RNA transcribed from the target gene, wherein the target gene is selected from the group consisting of: the genes identified in the Target Gene Sequences Group. In some embodiments, the polynucleotide comprises one or more nucleotide sequences selected from the Trigger Sequences Group, RNA Trigger Sequences Group, or RNA Trigger Sequences Reverse Complement Group or comprises nucleotide sequences at least about 75% or at least about 80% or at least about 85% or at least about 90% or at least about 95% or at least about 98% identical to the RNA Trigger Sequences or the RNA Trigger Sequence Reverse Complements. In some embodiments, the polynucleotide is dsRNA. In some embodiments the dsRNA comprises one or more sequences selected from the RNA Trigger Sequences and one or more corresponding sequence selected from the RNA Trigger Sequence Reverse Complements.

Several embodiments relate to a method for controlling *E. necator* infection of a plant comprising contacting *E. necator* with a polynucleotide comprising at least one segment of 18 or more contiguous nucleotides that are essentially identical or complementary to (e.g., a segment of 21 contiguous nucleotides with a sequence of 100% identity or complementarity with) the corresponding fragment of equivalent length of a portion of a DNA sequence of a target gene selected from the Target Gene Sequences Group. In some embodiments, the polynucleotide is double-stranded RNA.

Several embodiments relate to man-made compositions comprising at least one polynucleotide as described herein. In some embodiments, formulations useful for topical application to a plant or substance in need of protection from *E. necator* infection are provided. In some embodiments, recombinant constructs, and vectors useful for making transgenic grape plant cells and transgenic grape plants are provided. In some embodiments, formulations and coatings useful for treating grape plants, grape plant seeds or propagatable parts. In some embodiments, commodity products and foodstuffs produced from such grape plants, seeds, or propagatable parts treated with or containing a polynucleotide as described herein (especially commodity products and foodstuffs having a detectable amount of a polynucleotide as described herein) are provided. Several embodiments relate to polyclonal or monoclonal antibodies that bind a protein encoded by a sequence or a fragment of a sequence selected from the Target Gene Sequences Group. Another aspect relates to polyclonal or monoclonal antibodies that bind a protein encoded by a sequence or a fragment of a sequence selected from the Trigger Sequences Group, or the complement thereof. Such antibodies are made by routine methods as known to one of ordinary skill in the art.

Other aspects and specific embodiments of this invention are disclosed in the following detailed description.

DETAILED DESCRIPTION

I. Definitions

Figure 1:
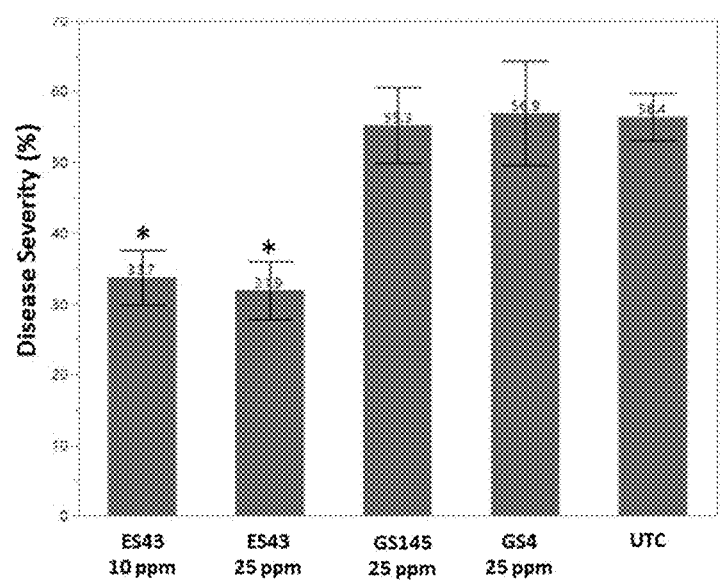
FIG. 1. Disease severity of leaf disks inoculated with *E. necator*. Three individual runs were combined to evaluate the effect of ES43-dsRNA (SEQ ID No. 108) on grapevine leaf disks. Significant decrease of fungal growth determined by disease severity was observed at both 10 and 25 ppm doses. Post hoc test (Dunnett's) showing significant differences between ES43 and controls GS145 or GS4 (p<0.01).

Unless defined otherwise, all technical and scientific terms used have the same meaning as commonly understood by one of ordinary skill in the art to which this invention belongs. Where a term is provided in the singular, the inventors also contemplate aspects of the invention described by the plural of that term. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" ($6^{th}$ edition, 2002, McGraw-Hill, New York), or the "Oxford Dictionary of Biology" ($6^{th}$ edition, 2008, Oxford University Press, Oxford and New York). The inventors do not intend to be limited to a mechanism or mode of action. Reference thereto is provided for illustrative purposes only.

Unless otherwise stated, nucleic acid sequences in the text of this specification are given, when read from left to right, in the 5' to 3' direction. One of skill in the art would be aware that a given DNA sequence is understood to define a corresponding RNA sequence which is identical to the DNA sequence except for replacement of the thymine (T) nucleotides of the DNA with uracil (U) nucleotides. Thus, providing a specific DNA sequence is understood to define the exact RNA equivalent. A given first polynucleotide sequence, whether DNA or RNA, further defines the sequence of its exact complement (which can be DNA or RNA), a second polynucleotide that hybridizes perfectly to the first polynucleotide by forming Watson-Crick base-pairs. For DNA:DNA duplexes (hybridized strands), base-pairs are adenine:thymine or guanine:cytosine; for DNA:RNA duplexes, base-pairs are adenine:uracil or guanine:cytosine. Thus, the nucleotide sequence of a blunt-ended double-stranded polynucleotide that is perfectly hybridized (where there is "100% complementarity" between the strands or where the strands are "complementary") is unambiguously defined by providing the nucleotide sequence of one strand, whether given as DNA or RNA. By "essentially identical" or "essentially complementary" to a target gene or a fragment of a target gene is meant that a polynucleotide strand (or at least one strand of a double-stranded polynucleotide) is designed to hybridize (generally under physiological conditions such as those found in a plant or fungal cell) to a target gene or to a fragment of a target gene or to the transcript of the target gene or the fragment of a target gene; one of skill in the art would understand that such hybridization does not necessarily require 100% sequence identity or complementarity. In some embodiments a trigger may be designed such that it is not 100% identical to a sequence of a target gene but remains complementary to a sequence for a target gene or an RNA transcribed therefrom. A first nucleic acid sequence is "operably" connected or "linked" with a second nucleic acid sequence when the first nucleic acid sequence is placed in a functional relationship with the second nucleic acid sequence. For example, a promoter sequence is "operably linked" to a DNA if the promoter provides for transcription or expression of the DNA. Generally, operably linked DNA sequences are contiguous.

The term "polynucleotide" commonly refers to a DNA or RNA molecule containing multiple nucleotides and generally refers both to "oligonucleotides" (a polynucleotide molecule of 18-25 nucleotides in length) and longer polynucleotides of 26 or more nucleotides. Polynucleotides also include molecules containing multiple nucleotides including non-canonical nucleotides or chemically modified nucleotides as commonly practiced in the art; see, e.g., chemical modifications disclosed in the technical manual "RNA Interference (RNAi) and DsiRNAs", 2011 (Integrated DNA Technologies Coralville, Iowa). Generally, polynucleotides as described herein, whether DNA or RNA or both, and whether single- or double-stranded, include at least one segment of 18 or more contiguous nucleotides (or, in the case of double-stranded polynucleotides, at least 18 contiguous base-pairs) that are essentially identical or complementary to a fragment of equivalent size of the DNA of a target gene or the target gene's RNA transcript. Throughout this disclosure, "at least 18 contiguous" means "from about 18 to about 10,000, including every whole number point in between". Thus, embodiments of this invention include oligonucleotides having a length of 18-25 nucleotides (18-mers, 19-mers, 20-mers, 21-mers, 22-mers, 23-mers, 24-mers, or 25-mers), or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e.g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where a polynucleotide is double-stranded, its length can be similarly described in terms of base pairs.

The polynucleotides described herein can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments include those wherein the polynucleotide is selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used. In some embodiments, the polynucleotide is double-stranded RNA of a length greater than that which is typical of naturally occurring regulatory small RNAs (such as endogenously produced siRNAs and mature miRNAs). In some embodiments, the polynucleotide is double-stranded RNA of at least about 30 contiguous base-pairs in length. In some embodiments, the polynucleotide is double-stranded RNA with a length of between about 50 to about 500 base-pairs. In some embodiments, the polynucleotide can include components other than standard ribonucleotides, e.g., an embodiment is an RNA that comprises terminal deoxyribonucleotides.

In various embodiments, the polynucleotide described herein comprises naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or one or more terminal dideoxyribonucleotides or synthetic polynucleotides consisting mainly of deoxyribonucleotides but with one or more terminal dideoxyribonucleotides. In certain embodiments, the polynucleotide comprises non-canonical nucleotides such as inosine, thiouridine, or pseudouridine. In certain embodiments, the polynucleotide comprises chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e.g., fluorescein or rhodamine) or other label (e.g., biotin).

As used herein, the term "isolated" refers to separating a molecule from other molecules normally associated with it in its native or natural state. The term "isolated" thus may refer to a DNA molecule that has been separated from other DNA molecule(s) which normally are associated with it in its native or natural state. Such a DNA molecule may be present in a recombined state, such as a recombinant DNA molecule. Thus, DNA molecules fused to regulatory or coding sequences with which they are not normally associated, for example as the result of recombinant techniques, are considered isolated, even when integrated as a transgene into the chromosome of a cell or present with other DNA molecules.

As used herein, the term "Target Gene Sequences Group" or "Target Gene Sequences" refers to the group of sequences comprising SEQ Id NOs: 1-107, 429-642. As used herein, the term "Trigger Sequences Group" or "Trigger Sequences" refers to the group of sequences comprising SEQ Id NOs: 108-214, 643-856. As used herein, the term "RNA Trigger Sequences Group" or "RNA Trigger Sequences" refers to the group of sequences comprising SEQ I NOs:215-321, 857-1070. As used herein, the term "RNA Trigger Sequences Reverse Complement Group" or "RNA Trigger Sequence Reverse Complements" refers to the group of sequences comprising SEQ ID NOs: 322-428, 1071-1284.

Several embodiments relate to a polynucleotide designed to suppress one or more genes ("target genes"). The term "gene" refers to any portion of a nucleic acid that provides for expression of a transcript or encodes a transcript. A "gene" can include, but is not limited to, a promoter region, 5' untranslated regions, transcript encoding regions that can include intronic regions, 3' untranslated regions, or combinations of these regions. In some embodiments, the target gene(s) can include coding or non-coding sequence or both. In other embodiments, the target gene has a sequence identical to or complementary to a messenger RNA, e.g., in some embodiments the target gene is represented by its corresponding cDNA. In specific embodiments, the polynucleotide is designed to suppress one or more target genes, where each target gene is encoded by a DNA sequence selected from the Target Gene Sequences Group. In various embodiments, the polynucleotide is designed to suppress or down-regulate one or more target genes, where each target gene is encoded by a sequence selected from the Target Gene Sequences Group and can be designed to suppress multiple target genes from this group, or to target different regions of one or more of these target genes. In an embodiment, the polynucleotide comprises multiple segments of 21 contiguous nucleotides with 100% identity with a fragment of equivalent length of a DNA or target gene having a sequence selected from the Target Gene Sequences Group or the DNA complement thereof. In such cases, each segment can be identical or different in size or in sequence and can be sense or anti-sense relative to the target gene. For example, in one embodiment the polynucleotide comprises multiple segments in tandem or repetitive arrangements, wherein each segment comprises 21 contiguous nucleotides with a sequence of 100% identity with a fragment of equivalent length of a DNA or target gene having a sequence selected from the Target Gene Sequences Group or the DNA complement thereof. In some embodiments, the segments can be from different regions of the target gene, e.g., the segments can correspond to different exon regions of the target gene. In some embodiments, "spacer" nucleotides which do not correspond to a target gene can optionally be used in between or adjacent to the segments.

Other Definitions are provided in the sections below.

II. Polynucleotides for Control of Powdery Mildew on Grape Plants

The polynucleotides of the current disclosure are useful for control or prevention of *E. necator* infection of grape plants via RNAi.

In some embodiments, the polynucleotide comprises at least one segment of 18 or more, 19 or more, 20 or more, 21 or more, 22 or more, 23 or more, 24 or more, 25 or more, 30 or more, 50 or more, 75 or more, 100 or more, 125 or more, 150 or more, 200 or more, 250 or more, 300 or more, 400 or more, 500 or more, 600 or more, 700 or more, 800 or more, 900 or more, or 1,000 or more contiguous nucleotides with a sequence of about 75% to about 100% identity, about 80% to about 100% identity, about 85% to about 100% identity, about 90% to about 100% identity, about 95% to about 100% identity, about 98% to about 100% identity, about 100% identity, or exactly 100% identity with a corresponding fragment of a DNA or a target gene having a sequence selected from the group consisting of: the Target Gene Sequences Group or in specific embodiments selected from the group consisting of SEQ ID NOs: 1, 2, 32, 35, 37, 61, 67, 74, 85, 88, 106, 555, and 614, or the DNA complement thereof or an RNA transcribed therefrom. In an embodiment, the polynucleotide comprises a nucleotide sequence that is essentially complementary to at least 18, at least 19, at least 20, at least 21, at least 22, at least 23, at least 24, at least 25, at least 30, at least 50, at least 75, at least 100, at least 125, at least 150, at least 200, at least 250, at least 300, at least 400, at least 500, at least 600, at least 700, at least 800, at least 900, or at least 1,000 contiguous nucleotides of a target gene having a nucleotide sequence selected from the group consisting of the Target Gene Sequences Group or in specific embodiments selected from the group consisting of SEQ ID NOs: 1, 2, 32, 35, 37, 61, 67, 74, 85, 88, 106, 555, and 614, or the DNA complement thereof or an RNA transcribed from such target gene.

In some embodiments the polynucleotide comprises at least 21 contiguous nucleotides essentially complementary to a corresponding fragment of a target gene having a DNA sequence selected from the group consisting of the Target Gene Sequences Group, or in specific embodiments selected from the group consisting of SEQ ID NOs: 1, 2, 32, 35, 37, 61, 67, 74, 85, 88, 106, 555, and 614, or the DNA complement thereof or an RNA transcribed therefrom. In some embodiments the polynucleotide comprises at least 21 contiguous nucleotides essentially complementary to a corresponding fragment of a target gene having a DNA sequence of SEQ ID NO:1, or the DNA complement thereof or an RNA transcribed therefrom. In some embodiments the polynucleotide comprises at least 400 contiguous nucleotides essentially complementary to a corresponding fragment of a target gene having a DNA sequence of SEQ ID NO:1, or the DNA complement thereof or an RNA transcribed therefrom. In some embodiments the polynucleotide is designed to have complementarity to a mRNA encoded for by a target gene. In some embodiments, the polynucleotide is double-stranded RNA. And in some embodiments the double-stranded RNA comprises one strand comprising the sequence of SEQ ID NO: 215 and a second strand complementary thereto.

In some embodiments, the polynucleotide comprises a sequence of contiguous nucleotides essentially complementary to or exactly (100%) identical to a fragment of equivalent length of a DNA or target gene having a sequence selected from the Target Gene Sequences Group or in specific embodiments selected from the group consisting of SEQ ID NOs: 1, 2, 32, 35, 37, 61, 67, 74, 85, 88, 106, 555, and 614, or the DNA complement thereof or an RNA transcribed therefrom. In some embodiments, the polynucleotide has an overall sequence of about 95%, about 96%, about 97%, about 98%, about 99%, or about 100% identity with a fragment of equivalent length of a DNA or target gene having a sequence selected from the Target Gene Sequences Group, or in specific embodiments selected from the group consisting of SEQ ID NOs: 1, 2, 32, 35, 37, 61, 67, 74, 85, 88, 106, 555, and 614, or the DNA complement thereof or an RNA transcribed therefrom. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In some embodiments, the polynucleotide comprises at least one segment of at least 18, 19, 20, or 21 (reference to at least 18, 19, 20, 21, etc. as used throughout is intended to mean that any of these lower limits of the group can be individualized) contiguous nucleotides with a sequence of 100% identity with a fragment of equivalent length of a DNA or target gene having a sequence selected from the Target Gene Sequences Group, or in specific embodiments selected from the group consisting of SEQ ID NOs: 1, 2, 32, 35, 37, 61, 67, 74, 85, 88, 106, 555, and 614, or the DNA complement thereof.

In an embodiment, the polynucleotide comprises at least one segment of 21 contiguous nucleotides essentially complementary to or with 100% identity with the corresponding fragment of a target gene having a DNA sequence selected of SEQ ID NO:1, or the DNA complement thereof or an RNA transcribed therefrom. In some embodiments, the polynucleotide comprises one or more "neutral" sequences (sequences having no sequence identity or complementarity to the target gene) in addition to one or more segments of 21 contiguous nucleotides with 100% identity with the corresponding fragment of the target gene, and therefore the polynucleotide as a whole is of much lower overall sequence identity with a target gene.

In an embodiment, the polynucleotide comprises a combination of multiple segments of 21 or more contiguous nucleotides complementary to or with 100% identity with the corresponding fragment of one or more target genes having a DNA sequence selected from the Target Gene Sequences Group, or in specific embodiments selected from the group consisting of SEQ ID NOs: 1, 2, 32, 35, 37, 61, 67, 74, 85, 88, 106, 555, and 614, or the DNA complement thereof or an RNA transcribed therefrom. In some embodiments, the polynucleotide comprises one or more "neutral" sequences (sequences having no sequence identity or complementarity to the target gene) in addition to one or more segments of 21 contiguous nucleotides with 100% identity with the corresponding fragments of 21 target gene, and therefore the polynucleotide as a whole is of much lower overall sequence identity with a given target gene. In an embodiment, the polynucleotide comprises of a combination of multiple segments of 21 or more contiguous nucleotides or longer complementary to or with 100% identity with the corresponding fragments locationally distributed throughout the length of the target gene having a DNA sequence selected from the Target Gene Sequences Group, or in specific embodiments selected from the group consisting of SEQ ID NOs: 1, 2, 32, 35, 37, 61, 67, 74, 85, 88, 106, 555, and 614, or the DNA complement thereof, or an RNA transcribed therefrom. In some embodiments, the polynucleotide comprises one or more "neutral" sequences (sequences having no sequence identity or complementarity to the target gene) in addition to one or more segments of 21 contiguous nucleotides with 100% identity with the corresponding fragments locationally distributed throughout the length of the target gene, and therefore the polynucleotide as a whole is of much lower overall sequence identity with a given target gene.

In some embodiments, the polynucleotide comprises a sequence essentially complementary to or about 75% to about 100%, about 80% to about 100%, about 85% to about 100%, about 90% to about 100%, 95% to about 100%, about 98% to about 100%, about 100%, or 100% identical to at least 18, at least 19, at least 20, at least 21, at least 22, at least 23, at least 24, at least 25, at least 50, at least 75, at least 100, at least 150, at least 200, at least 300, at least 400, or at least 500 contiguous nucleotides of a sequence selected from the group consisting of the RNA Trigger Sequences Group or RNA Trigger Sequence Reverse Complement Group, or in specific embodiments selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256.

In some embodiments, the polynucleotide comprises a sequence at least about 75%, at least about 80%, at least about 85%, at least about 90%, at least about 95%, at least about 98%, about 100%, or exactly 100% identical to a sequence selected from the RNA Trigger Sequences or the RNA Trigger Sequences Reverse Complements or in specific embodiments selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments the polynucleotide comprises a nucleotide sequence selected from a group consisting of SEQ ID Nos: 108-214, 643-856, 215-321, 857-1070, 322-428, and 1071-1284. In some embodiments, the polynucleotide comprises a sequence at least about 75%, at least about 80%, at least about 85%, at least about 90%, at least about 95%, at least about 98%, about 100%, or exactly 100% identical to a sequence selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the polynucleotide comprises a sequence at least about 75%, at least about 80%, at least about 85%, at least about 90%, at least about 95%, at least about 98%, about 100%, or exactly 100% identical to a sequence selected from the group consisting of SEQ ID NOs: 108, 215, and 322.

Several embodiments relate to a polynucleotide comprising a sequence of about 95% to about 100% identity with a sequence selected from group consisting of the RNA Trigger Sequence Group or RNA Trigger Sequences Reverse Complement Group or in specific embodiments selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. Several embodiments relate to a polynucleotide comprising at least one segment of 18 or more contiguous nucleotides with a sequence of about 95% to about 100% identity to a portion of sequence selected from the group consisting of the RNA Trigger Sequences Group or RNA Trigger Sequences Reverse Complement Group, or in specific embodiments selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the contiguous nucleotides number at least 18, e.g., between 18-24, or between 18-28, or between 20-30, or between 20-50, or between 20-100, or between 50-100, or between 50-500, or between 100-250, or between 100-500, or between 200-1, 000, or between 500-2,000, or even greater. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In some embodiments, the polynucleotide comprises at least one segment of at least 18, 19, 20, or 21 (reference to at least 18, 19, 20, 21, etc. as used throughout is intended to mean that any of these lower limits of the group can be individualized) contiguous nucleotides with a sequence of 100% identity with a fragment of equivalent length found in a sequence selected from the group consisting of the Trigger Sequences Group, the RNA Trigger Sequences Group, and the RNA Trigger Sequences Reverse Complement Group or in specific embodiments selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the polynucleotide comprises at least one segment of at least 200, 300, 400, or 500 contiguous nucleotides with a sequence of at least 85% identity with a fragment of equivalent length found in a sequence selected from the group consisting of the Trigger Sequences Group, the RNA Trigger Sequences Group, and the RNA Trigger Sequences Reverse Complement Group or in specific embodiments selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the polynucleotide comprises at least one segment of at least 200, 300, 400, or 500 contiguous nucleotides, at least 85% identical to a fragment of equivalent length found SEQ ID NO: 215.

In some embodiments, the polynucleotide is a double-stranded nucleic acid (e.g., dsRNA) with one strand comprising at least one segment of at least 18, 19, 20, 21, 22, 23, 24, 50, 75, 100, 150, 200, 250, 300, 400, or 500 contiguous nucleotides with about 95% to 100% identity to a fragment of equivalent length of a DNA or target gene having a sequence selected from the Target Gene Sequences Group, or specifically selected from the group consisting of SEQ ID Nos. 1, 2, 32, 35, 37, 61, 67, 74, 85, 88, 106, 555, and 614, or the DNA complement thereof. Expressed as base-pairs, such a double stranded nucleic acid comprises at least one segment of at least 18, 19, 20, 21, 22, 23, 24, 50, 75, 100, 150, 200, 250, 300, 400, or 500 contiguous, perfectly matched base-pairs which correspond to a fragment of equivalent length of a DNA or target gene having a sequence selected from the Target Gene Sequences Group, or specifically selected from the group consisting of SEQ ID NOs: 1, 2, 32, 35, 37, 61, 67, 74, 85, 88, 106, 555, and 614 or the DNA complement thereof. In some embodiments, each segment contained in the polynucleotide is of a length greater than that which is typical of naturally occurring regulatory small RNAs, for example, each segment is at least about 30 contiguous nucleotides (or base-pairs) in length. In some embodiments, the total length of the polynucleotide, or the length of each segment contained in the polynucleotide, is less than the total length of the DNA or target gene having a sequence selected from the Target Gene Sequences Group, or specifically selected from the group consisting of SEQ ID NOs: 1, 2, 32, 35, 37, 61, 67, 74, 85, 88, 106, 555, and 614. In some embodiments, the total length of the polynucleotide is between about 50 to about 500 nucleotides (for single-stranded polynucleotides) or base-pairs (for double-stranded polynucleotides). In some embodiments, the polynucleotide is a dsRNA of between about 100 to about 500 base-pairs, such as a dsRNA of the length of any of the RNA Trigger Sequences disclosed in the Figures and Tables. In some embodiments the dsRNA comprises one strand comprising a sequence selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the dsRNA comprises one strand comprising at least one segment of at least 200, 300, 400, or 500 contiguous nucleotides with a sequence of at least 85% identity with a fragment of equivalent length found in a sequence selected from the group consisting of the Trigger Sequences Group, the RNA Trigger Sequences Group, and the RNA Trigger Sequences Reverse Complement Group or in specific embodiments selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the dsRNA comprises one strand comprising at least one segment of at least 200, 300, 400, or 500 contiguous nucleotides, at least 85% identical to a fragment of equivalent length found SEQ ID NO: 215.

In some embodiments the polynucleotide is designed to have complementarity to a mRNA encoded for by a target gene. In some embodiments, the polynucleotide is dsRNA. In some embodiments the dsRNA comprises a first strand that binds to (e.g., is essentially complementary to) a mRNA encoded by a target gene, and a second strand that is complementary to the first strand. The dsRNA may comprise RNA strands that are the same length or different lengths. In some embodiments, the dsRNA comprises a first strand (e.g., an antisense strand) that is the same length as a second strand (e.g., a sense strand). In some embodiments, the dsRNA comprises a first strand (e.g., an antisense strand) that is a different length than a second strand (e.g., a sense strand). A first strand may be about 1%, 2%, 3%, 4%, 5%, 10%, 15%, 20%, or more than 20% longer than a second strand. A first strand may be 1-5, 2-5, 2-10, 5-10, 5-15, 10-20, 15-20, or more than 20 nucleotides longer than a second strand. dsRNA molecules can also be assembled from a single oligonucleotide in a stem-loop structure, wherein self-complementary sense and antisense regions of the RNA molecule are linked by means of a nucleic acid based or non-nucleic acid-based linker(s), as well as circular single stranded RNA having two or more loop structures and a stem comprising self-complementary sense and antisense strands, wherein the circular RNA can be processed either in vivo or in vitro to generate an active RNAi molecule capable of mediating RNAi. An RNAi molecule may comprise a 3' overhang at one end of the molecule; the other end may be blunt-ended or also possess an overhang (5' or 3). When the RNAi molecule comprises an overhang at both ends of the molecule, the length of the overhangs may be the same or different.

In some embodiments, the polynucleotide is designed to have complementarity to a region of an *E. necator* gene that is conserved across several isolates of *E. necator*. Different isolates may have variations in the nucleotide sequence of the same gene. By designing a polynucleotide trigger in this way, efficacy is more likely against multiples isolates of *E. necator*, allowing for one product that is effective at controlling *E. necator* found in different geographic regions or within a geographic region in which two or more isolates may be found. In one such embodiment, the gene target is the Cyp51 gene from two or more isolates of *E. necator*. In some embodiments the gene target is the Cyp51 gene from three or more, four or more, five or more, six or more, or seven or more isolates of *E. necator*. In some embodiments the two or more isolates are selected from the group consisting of the LNYM, NY90, G14, Pumocnh, SHNC1, BLMT2, Dresden2, NCAES6, CH36, and CH19 strains of *E. Necator*. Specific embodiments include those in which the polynucleotide is a dsRNA comprising one strand comprising SEQ ID NO: 215 or the complement thereof. Other such embodiments include those in which the polynucleotide comprises at least one segment of 18, 19, 20, 21, 22, 23, 24, 50, 75, 100, 150, 200, 250, 300, 400, or 500 or more contiguous nucleotides with about 95% to about 100% identity to an equivalent fragment of SEQ ID NO: 215.

In some embodiments, the dsRNA comprises one strand comprising one or more nucleotide sequences at least about 75%, at least about 80%, at least about 85%, at least about 90%, at least about 95%, at least about 98%, about 100%, or exactly 100% identical to a sequence selected from the RNA Trigger Sequences or the RNA Trigger Sequence Reverse Complements. In some embodiments the dsRNA comprises at least one segment of 18, 19, 20, 21, 22, 23, 24, 50, 75, 100, 150, 200, 250, 300, 400, or 500 or more contiguous nucleotides with about 95% to about 100% identity to a portion of a sequence selected from the RNA Trigger Sequences Group or RNA Trigger Sequences Reverse Complement Group or in specific embodiments selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. Such dsRNA may further comprise a second strand complementary to the first strand. In some embodiments the dsRNA comprises a first strand comprising a nucleotide sequence selected from the RNA Trigger Sequences and a second strand selected from the corresponding RNA Trigger Sequence Reverse Complements or another sequence complementary to the sequence of the first strand. Specific embodiments include those in which the polynucleotide is a dsRNA comprising a first strand comprising a nucleotide sequence selected from the group consisting of SEQ ID NOs: 215, 216, 246, 249, 251, 275, 281, 288, 299, 302, 320, 983, and 1042.

III. Length of Polynucleotides

RNAi molecules targeting the target genes as provided herein may vary in length. It should be understood that, in some embodiments, while a long RNA (e.g., dsRNA or ssRNA) molecule is applied (e.g., to a plant) as the fungicide, after entering cells the dsRNA is cleaved by the Dicer enzyme into shorter double-stranded RNA fragments having a length of, for example, 15 to 25 nucleotides. Thus, RNAi molecules of the present disclosure may be delivered as 15 to 25 nucleotide fragments, for example, or they may be delivered as longer double-stranded nucleic acids (e.g., at least 100 nucleotides).

The total length of the polynucleotides of the present inventions can be greater than or equal to 18 contiguous nucleotides and can include nucleotides in addition to the contiguous nucleotides having the sequence of about 75% to about 100% identity with a fragment of equivalent length of a DNA or target gene having a sequence selected from the group consisting of: the Target Gene Sequences Group or the DNA complement thereof or an RNA transcribed therefrom. Similarly, the polynucleotides of the present invention may comprise one or more sequences about 75% to about 100% identical to 18 or more contiguous nucleotides of a sequence selected from the group consisting of the Trigger Sequences Group, the RNA Trigger Sequences Group, or the RNA Trigger Sequences Reverse Complement Group, and in addition may comprise additional unrelated sequences. In other words, the total length of the polynucleotide can be greater than the length of the section or segment of the polynucleotide designed to suppress one or more target genes.

For example, the polynucleotide can have nucleotides flanking the "active" segment (e.g., an "active" segment could be a sequence essentially complementary to a segment of a target gene or an mRNA transcribed therefrom or could be a sequence selected from the Trigger Sequences Group, the RNA Trigger Sequences Group, or the RNA Trigger Sequences Reverse Complement Group) that suppresses the target gene, or include "spacer" nucleotides between active segments, or can have additional nucleotides at the 5' end, or at the 3' end, or at both the 5' and 3' ends. In an embodiment, the polynucleotide can include additional nucleotides that are not specifically related (having a sequence not complementary or identical to) to the sequences disclosed herein for control of powdery mildew. For example, such polynucleotides may contain nucleotides that provide stabilizing secondary structure or for convenience in cloning or manufacturing. In an embodiment, the polynucleotide can include additional nucleotides located immediately adjacent to an active segment. In an embodiment, the polynucleotide comprises one such segment, with an additional 5' G or an additional 3' C or both, adjacent to the segment. In another embodiment, the polynucleotide is a double-stranded RNA comprising additional nucleotides to form one or more overhangs, for example, a dsRNA comprising 2 deoxyribonucleotides to form a 3' overhang. In other embodiments, the polynucleotide may comprise one or more active segments recited herein as well as additional segments active against other target genes of *E. necator* or active against another fungus or pest.

Thus in various embodiments, the nucleotide sequence of the entire polynucleotide is not 100% identical or complementary to the Trigger Sequences Group, the RNA Trigger Sequences Group, or the RNA Trigger Sequences Reverse Complement Group and is not 100% identical or complementary to a sequence of contiguous nucleotides in the DNA or target gene having a sequence selected from the group consisting of: the Target Gene Sequences Group, or the DNA complement thereof. For example, in some embodiments the polynucleotide comprises at least two segments each of 21 contiguous nucleotides with a sequence of 100% identity with a fragment of a DNA having a sequence selected from the group consisting of: the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the group consisting of: the Target Gene Sequences Group, or the DNA complement thereof.

Several embodiments relate to polynucleotides that are designed to modulate expression by inducing down-regulation or suppression of *E. necator* target gene. In some embodiments, the polynucleotides are designed to have a nucleotide sequence essentially identical or essentially complementary to the nucleotide sequence of *E. necator* target gene or cDNA (e.g., The Target Gene Sequences Group) or to the sequence of RNA transcribed from *E. necator* target gene, which can be coding sequence or non-coding sequence. These effective polynucleotide molecules that modulate expression may be referred to herein as a "polynucleotide", "polynucleotide trigger", "trigger", or "triggers". Examples of such embodiments include a polynucleotide comprising one or more sequences selected from the RNA Trigger Sequence Group, RNA Trigger Sequences Reverse Complement Group. Further examples include a polynucleotide comprising at least one segment of 18 or more contiguous nucleotides with a sequence of about 95% to about 100% identity to a portion of a sequence selected from the RNA Trigger Sequences Group or RNA Trigger Sequences Reverse Complement Group.

Effective polynucleotides of any size can be used, alone or in combination, in the various methods and compositions described herein. In some embodiments, a single polynucleotide trigger is used to make a composition (e.g., a composition for topical application, or a recombinant DNA construct useful for making a transgenic plant). In other embodiments, a mixture or pool of different polynucleotide triggers is used; in such cases the polynucleotide triggers can be for a single target gene or for multiple target genes.

IV. Permitted Mismatches

"Essentially identical" or "essentially complementary", as used herein, means that a polynucleotide (or at least one strand of a double-stranded polynucleotide) has sufficient identity or complementarity to the target gene or to the RNA transcribed from a target gene (e.g., the transcript) to suppress expression of a target gene (e.g., to affect a reduction in levels or activity of the target gene transcript and/or encoded protein). Polynucleotides as described herein need not have 100 percent identity or complementarity to a target gene or to the RNA transcribed from a target gene to suppress expression of the target gene (e.g., to affect a reduction in levels or activity of the target gene transcript or encoded protein, or to provide control of *E. necator*). In some embodiments, the polynucleotide or a portion thereof is designed to be essentially identical to, or essentially complementary to, a sequence of at least 18 or 19 contiguous nucleotides in either the target gene or the RNA transcribed from the target gene. In some embodiments, the polynucleotide or a portion thereof is designed to be 100% identical to, or 100% complementary to, one or more sequences of 21 contiguous nucleotides in either the target gene or the RNA transcribed from the target gene. In certain embodiments, an "essentially identical" polynucleotide has 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the endogenous target gene or to an RNA transcribed from the target gene. In certain embodiments, an "essentially complementary" polynucleotide has 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene.

Sequence identity: The term "sequence identity" or "identity," as used herein in the context of two polynucleotides or polypeptides, refers to the residues in the sequences of the two molecules that are the same when aligned for maximum correspondence over a specified comparison window.

Percentage identity is calculated by determining the number of positions at which the identical nucleotide or amino acid residue occurs in both sequences to yield the number of matched positions, dividing the number of matched positions by the total number of positions in the comparison window, and multiplying the result by 100 to yield the percentage of sequence identity. A sequence that is identical at every position in comparison to a reference sequence is said to be 100% identical to the reference sequence, and vice-versa. The percent identity of two nucleotide sequences may be determined by comparing two optimally aligned sequences (e.g., nucleic acid sequences or polypeptide sequences) of a molecule over a comparison window, wherein the portion of the sequence in the comparison window may comprise additions or deletions (i.e., gaps) as compared to the reference sequence (which does not comprise additions or deletions) for optimal alignment of the two sequences. Optimal alignment to compare two or more sequences may be performed using local or global alignment through a variety of available computer programs. The algorithm of Smith T. F. and Waterman M. S. (1981) Identification of common molecular subsequences J. Mol. Biol. 147(1):195-7 PubMed: 7265238 DOI: 10.1016/0022-2836(81)90087-5 is a suitable local alignment strategy and is utilized by tools such as EMBOSS Water ebi.ac.uk/Tools/psa/emboss_water/). The algorithm of Needleman S. B. and Wunsch C. D. (1970) A general method applicable to the search for similarities in the amino acid sequence of two proteins J. Mol. Biol. 48(3):443-53 PubMed: 5420325 DOI: 10.1016/0022-2836(70)90057-4 is a suitable global alignment strategy and is utilized by such tools as EMBOSS Needle ebi.ac.uk/Tools/psa/emboss_needle/). Depending on the sequences to be compared and the relevant parameters, a local or global alignment strategy may be more likely to find an optimal alignment, but both strategies may be utilized to confirm the optimal alignment giving the most accurate percent identity.

The term "about" with respect to a numerical value of a sequence length means the stated value with a +/− variance of up to 1-5 percent. For example, about 30 contiguous nucleotides means a range of 27-33 contiguous nucleotides, or any range in between. The term "about" with respect to a numerical value of percentage of sequence identity means the stated percentage value with a +/− variance of up to 1-3 percent rounded to the nearest integer. For example, about 90% sequence identity means a range of 87-93%. However, the percentage of sequence identity cannot exceed 100 percent. Thus, about 98% sequence identity means a range of 95-100%.

Polynucleotides containing mismatches to the target gene or transcript can be used in certain embodiments of the compositions and methods described herein. The variants provided herein, in some embodiments, contain randomly placed mutations with the four nucleotides (A, U, G, C) selected at an approximately equal probability for a given mutation. In some embodiments, these mutations might be distributed either over a small region of the sequence, or widely distributed across the length of the sequence. In some embodiments, the polynucleotide includes at least 18 or at least 19 or at least 21 contiguous nucleotides that are essentially identical or essentially complementary to a segment of equivalent length in the target gene or target gene's transcript. In certain embodiments, a polynucleotide of 18, 19, 20, or 21 or more contiguous nucleotides that is essentially identical or essentially complementary to a segment of equivalent length in the target gene or target gene's transcript can have 1 or 2 mismatches to the target gene or transcript (i.e., 1 or 2 mismatches between the polynucleotide's 21 contiguous nucleotides and the segment of equivalent length in the target gene' or target gene's transcript). In certain embodiments, a polynucleotide of about 50, 100, 150, 200, 250, 300, 350 or more nucleotides that contains a contiguous 18, 19, 20, or 21 or more nucleotide span of identity or complementarity to a segment of equivalent length in the target gene or target gene's transcript can have 1 or 2 or more mismatches to the target gene or transcript.

In designing polynucleotides with mismatches to an endogenous target gene or to an RNA transcribed from the target gene, mismatches of certain types and at certain positions that are more likely to be tolerated can be used. In certain embodiments, mismatches formed between adenine and cytosine or guanosine and uracil residues are used as described by Du et al. (2005) *Nucleic Acids Res.,* 33:1671-1677. In some embodiments, mismatches in 19 base-pair overlap regions are located at the low tolerance positions 5, 7, 8 or 11 (from the 5' end of a 19-nucleotide target), at medium tolerance positions 3, 4, and 12-17 (from the 5' end of a 19-nucleotide target), and/or at the high tolerance positions at either end of the region of complementarity, i.e., positions 1, 2, 18, and 19 (from the 5' end of a 19-nucleotide target) as described by Du et al. (2005) *Nucleic Acids Res.,* 33:1671-1677. Tolerated mismatches can be empirically determined in routine assays.

V. Embedding Silencing Elements in Neutral Sequence

In some embodiments, a silencing element comprising a sequence corresponding to the target gene and which is responsible for an observed suppression of the target gene is embedded in "neutral" sequence, i.e., inserted into additional nucleotides that have no sequence identity or complementarity to the target gene. Neutral sequence can be desirable, e.g., to increase the overall length of a polynucleotide or to impart desirable characteristics such as increased binding to the silencing complex. For example, it can be desirable for a polynucleotide to be of a particular size for reasons of stability, cost-effectiveness in manufacturing, or efficacious biological activity such as silencing efficiency. In some embodiments, neutral sequence is also useful in forming favorable secondary structures such as the loop in a hairpin trigger or as a spacer between trigger regions.

Thus, in one embodiment, a 21-base-pair dsRNA silencing element corresponding to a target gene in the Target Gene Sequences Group and found to provide control of a *E. necator* infection is embedded in neutral sequence of an additional 39 base pairs, thus forming a polynucleotide of about 60 base pairs. In some embodiments, the dsRNA trigger includes neutral sequence of between about 60 to about 500, or between 100 to about 450 base-pairs, in which is embedded at least one segment of 21 contiguous nucleotides with a sequence of 100% identity or 100% complementarity with a fragment of equivalent length of a target gene having a sequence selected from the Target Gene Sequences Group. In another embodiment, a single 21-base-pair silencing element with a sequence of 100% identity or 100% complementarity with a fragment of equivalent length of a target gene is found to be efficacious when embedded in larger sections of neutral sequence, e.g., where the total polynucleotide length is from about 60 to about 300 base pairs. In embodiments where the polynucleotide includes regions of neutral sequence, the polynucleotide will have relatively low overall sequence identity in comparison to the target gene; for example, a dsRNA with an overall length of 210 base-pairs, containing a single 21-base-pair trigger (of 100% identity or complementarity to a 21-nucleotide fragment of a target gene) embedded in an additional 189 base-pairs of neutral sequence, will have an overall sequence identity with the target gene of about 10%.

VI. Related Techniques

Embodiments of the polynucleotides and nucleic acid molecules as described herein can include additional elements, such as promoters, transcription initiation elements, transcription elongation elements, transcription stop elements, small RNA recognition sites, aptamers or ribozymes, additional and additional expression cassettes for expressing coding sequences (e.g., to express a transgene such as a fungicidal protein or selectable marker) or non-coding sequences (e.g., to express additional suppression elements). For example, an aspect of this invention provides a recombinant DNA construct comprising a heterologous promoter with a transcription initiation sequence operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. Another aspect of the invention provides a recombinant DNA construct comprising a heterologous promoter with a transcription initiation sequence operably linked to DNA encoding an RNA hairpin having an anti-sense region having a sequence, or a fragment of a sequence, selected from the group selected from the Trigger Sequences Group, RNA Trigger Sequences Group, or RNA Trigger Sequences Reverse Complement Group. In another embodiment, a recombinant DNA construct comprising a promoter operably linked to DNA encoding: (a) an RNA silencing element for suppressing a target gene selected from the Target Gene Sequences Group, and (b) an aptamer, is stably integrated into the plant's genome from where RNA transcripts including the RNA aptamer and the RNA silencing element are expressed in cells of the plant; the aptamer serves to guide the RNA silencing element to a desired location in the cell. In another embodiment, inclusion of one or more recognition sites for binding and cleavage by a small RNA (e.g., by a miRNA or an siRNA that is expressed only in a particular cell or tissue) allows for more precise expression patterns in a plant, wherein the expression of the recombinant DNA construct is suppressed where the small RNA is expressed. Such additional elements are described below.

VII. Controlling *E. necator* Infection by Contacting with a Polynucleotide

Provided herein are methods for controlling *E. necator* infection of a plant. Such methods include contacting *E. necator* with any of the polynucleotides and other compositions described herein. Some embodiments relate to methods for controlling *E. necator* infection of a plant by contacting the plant with any of the polynucleotides described in section II supra or elsewhere herein. Some embodiments relate to methods for controlling *E. necator* infection of a plant by contacting *E. necator* with a polynucleotide comprising at least one segment of 18 or more contiguous nucleotides having about 95% to about 100% identity or complementarity with a corresponding fragment of a DNA or target gene selected from the group consisting of: the Target Gene Sequences Group, or the DNA complement thereof. In an embodiment, the method for controlling *E. necator* infection of a plant comprises contacting *E. necator* with a polynucleotide comprising at least 18 contiguous nucleotides with 100% identity with a corresponding fragment of a target gene having a DNA sequence of SEQ ID NO:1, or the DNA complement thereof. In other embodiments, the method for controlling *E. necator* infection of a plant comprises contacting *E. necator* with a polynucleotide comprising at least 18 contiguous nucleotides with 100% identity with a corresponding fragment of a target gene having a DNA sequence selected from the group consisting of SEQ ID NOs: 2, 32, 35, 37, 61, 67, 74, 85, 88, 106, 555, and 614, or the DNA complement thereof.

In some embodiments, the polynucleotide is a double-stranded RNA. In some embodiments, the polynucleotide (e.g., double-stranded RNA) is chemically or enzymatically synthesized or is produced by expression in a microorganism or by expression in a plant cell. Embodiments include those in which the polynucleotide is a dsRNA comprising a strand having a sequence selected from the Trigger Sequences Group, the RNA Trigger Sequences Group, or the RNA Trigger Sequences Reverse Complement Group. Embodiments further include those in which the polynucleotide comprises at least one segment of 18 or more contiguous nucleotides with a sequence of about 95% to about 100% identity to a portion of a sequence selected from the RNA Trigger Sequences Group or RNA Trigger Sequences Reverse Complement Group. Polynucleotides of use in the method can be designed for multiple target genes. Related aspects of the invention include isolated polynucleotides of use in the method and plants having improved E. necator resistance provided by the method. Specific embodiments include those in which the polynucleotide is a dsRNA comprising a sequence of SEQ ID NO: 215, or the complement thereof.

In some embodiments, the contiguous nucleotides have a sequence of about 95%, about 96%, about 97%, about 98%, about 99%, or about 100% identity with a fragment of equivalent length of a DNA or target gene having a sequence selected from the Target gene sequences group, or the DNA complement thereof. In some embodiments, the contiguous nucleotides are exactly (100%) identical to a fragment of equivalent length of a DNA or target gene having a sequence selected from the Target Gene Sequences Group or the DNA complement thereof. In some embodiments, the polynucleotide has an overall sequence of about 95%, about 96%, about 97%, about 98%, about 99%, or about 100% identity with a fragment of equivalent length of a DNA or target gene having a sequence selected from the Target Gene Sequences Group or the DNA complement thereof.

In an embodiment, the polynucleotide comprises at least one segment of 21 contiguous nucleotides with 100% identity with the corresponding fragment of a target gene having a DNA sequence selected of SEQ ID NO:1, or the DNA complement thereof. In some embodiments, the polynucleotide comprises "neutral" sequence (sequence having no sequence identity or complementarity to the target gene) in addition to one or more segments of 21 contiguous nucleotides with 100% identity with the corresponding fragment of the target gene, and therefore the polynucleotide as a whole is of much lower overall sequence identity with a target gene.

In some embodiments the polynucleotide of use in this method is provided as an isolated DNA or RNA fragment. In some embodiments the polynucleotide of use in this method is not part of an expression construct and is lacking additional elements such as a promoter or terminator sequences). Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers of SEQ ID NOs: 108-214, 643-856, 215-321, 857-1070, 322-428, 1071-1284. Alternatively, the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., a fungicidal protein).

Several embodiments relate to a method for controlling E. necator infection of a plant comprising contacting E. necator with a polynucleotide comprising at least one segment of 18 or more contiguous nucleotides that is essentially identical or complementary to a fragment of equivalent length of a DNA of a target gene selected from the group consisting of the genes identified in the Target Gene Sequences Group. In some embodiments the polynucleotide comprises a dsRNA with a strand having a sequence selected from the group consisting of the Trigger Sequences Group. In some embodiments, this invention provides a method for controlling E. necator infection of a plant comprising contacting E. necator with an effective amount of a solution comprising a double-stranded RNA from the Trigger Sequences Group, the solution further comprises an organosilicone surfactant.

In various embodiments of the method, the contacting comprises application to a surface of a grape plant that is or may become infected by E. necator, of a suitable composition comprising any of the polynucleotides described herein (e.g., the polynucleotides described in section II, the dsRNA described in section VIII, or the compositions described in section IX); such a composition can be provided, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a leaf, seed, root, or stem treatment. In an embodiment, the surface is the leaves, flowers, or fruit of a grape plant. In such an embodiment the application may be achieved by spraying the leaves, flowers, or fruit of a grape plant. The contacting can also be in the form of a seed treatment. Suitable binders, inert carriers, surfactants, and the like can optionally be included in the composition, as is known to one skilled in formulation of pesticides and seed treatments. In some embodiments, the contacting comprises providing the polynucleotide in a composition that further comprises one or more carrier agents and/or one or more surfactants, (e.g., an organosilicone, an organosilicone surfactant), a polynucleotide herbicidal molecule, a non-polynucleotide herbicidal molecule, a non-polynucleotide pesticide, a polynucleotide pesticide, a safener, and a pathogen growth regulator. In one embodiment the contacting comprises providing the polynucleotide in a composition that can be transfected into or otherwise absorbed internally by E. necator.

VIII. Fungicidal Double-Stranded RNA Molecules

Another aspect of this invention provides a fungicidal double-stranded RNA molecule that causes mortality, suppression of growth, a decrease in virulence or pathogenicity, or decrease in propagation/reproduction capacity (sporulation) in E. necator when transfected into or contacted by E. necator wherein the fungicidal double-stranded RNA comprises a nucleotide sequence of any of the polynucleotides described in section II supra or elsewhere herein. Certain embodiments of the invention provides a fungicidal double-stranded RNA molecule that causes mortality, suppression of growth, or decrease in virulence or pathogenicity, or decrease in propagation/reproduction capacity (sporulation) in E. necator on v. vinifera when transfected into or contacted by E. necator wherein the fungicidal double-stranded RNA molecule comprises at least one segment of 18 or more contiguous nucleotides that is essentially identical or essentially complementary to a segment of equivalent length of a target gene or DNA (cDNA) having a sequence selected from The Target Gene Sequences Group. In some embodiments, the fungicidal dsRNA comprises a first strand comprising one or more sequences selected from the Trigger Sequences Group, RNA Trigger Sequences Group, or RNA Trigger Sequences Reverse Complement Group. In some embodiments, the fungicidal dsRNA comprises a first strand comprising a sequence essentially complementary to or about 75% to about 100%, about 80% to about 100%, about 85% to about 100%, about 90% to about 100%, 95% to about 100%, about 98% to about 100%, about 100%, or 100% identical to at least 18, at least 19, at least 20, at least 21, at least 22, at least 23, at least 24, at least 25, at least 50, at least 75, at least 100, at least 150, at least 200, at least 300, at least 400, or at least 500 contiguous nucleotides of a sequence selected from the group consisting of SEQ ID NOs: 215-321; 857-1070, 322-428, and 1071-1284 or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments the fungicidal dsRNA comprises at least one segment of 18 or more contiguous nucleotides with about 95% to about 100% identity to a portion of a sequence selected from the group consisting of the RNA Trigger Sequences Group or RNA Trigger Sequences Reverse Complement Group or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the fungicidal dsRNA comprises a first strand comprising a sequence at least about 75%, at least about 80%, at least about 85%, at least about 90%, at least about 95%, at least about 98%, about 100%, or exactly 100% identical to a sequence selected from the RNA Trigger Sequences or the RNA Trigger Sequence Reverse Complements. In some embodiments the fungicidal dsRNA comprises a nucleotide sequence selected from a group consisting of SEQ ID Nos: 215-321; 857-1070, 322-428, 1071-1284 or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments the fungicidal dsRNA further comprises a second strand complementary to the first strand. In some embodiments the fungicidal dsRNA comprises a first strand comprising a nucleotide sequence selected from the RNA Trigger Sequences and further comprises a second strand comprising a sequence selected from the corresponding RNA Trigger Sequence Reverse Complements. In some embodiments the fungicidal dsRNA comprises a first strand comprising a nucleotide sequence selected from the group consisting of SEQ ID NOs: 215, 216, 246, 249, 251, 275, 281, 288, 299, 302, 320, 983, and 1042 and further comprises a second strand comprising a sequence selected from the corresponding complementary sequence selected from the group consisting of SEQ ID NOs: 322, 323, 353, 356, 358, 382, 388, 395, 406, 409, 427, 1197, and 1256.

The total length of one strand of the fungicidal dsRNA can be greater than or equal to 18 contiguous nucleotides, and can include nucleotides in addition to the contiguous nucleotides having the sequence of about 95% to about 100% a portion of a sequence selected from the RNA Trigger Sequences Group or RNA Trigger Sequence Reverse Complements or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. The fungicidal dsRNA comprising a nucleotide sequence selected from the RNA Trigger Sequences Group and the RNA Trigger Sequences Reverse Complement Group can include nucleotides in addition to the nucleotides of the sequence selected from the RNA Trigger Sequences Group and the RNA Trigger Sequences Reverse Complement Group. In other words, the total length of the dsRNA strand can be greater than the length of the sequence or portion of a sequence selected from the RNA Trigger Sequences Group or RNA Trigger Sequence Reverse Complement. For example, the dsRNA can have nucleotides flanking the "active" segment that suppresses the target gene, or include "spacer" nucleotides between active segments, or can have additional nucleotides at the 5' end, or at the 3' end, or at both the 5' and 3' ends. In an embodiment, the dsRNA can include additional nucleotides that are not specifically related (having a sequence not complementary or identical to) to the target gene being targeted by a given trigger, e.g., nucleotides that provide stabilizing secondary structure or for convenience in cloning or manufacturing. In an embodiment, the dsRNA can include additional nucleotides located immediately adjacent to the sequence or portion of a sequence selected from the RNA Trigger Sequences Group or RNA Trigger Sequences Reverse Complement Group. In an embodiment, the dsRNA comprises one such segment, with an additional 5' G or an additional 3' C or both, adjacent to the segment. In another embodiment, the dsRNA further comprises additional nucleotides to form an overhang, for example, a dsRNA comprising 2 deoxyribonucleotides to form a 3' overhang. Thus, in various embodiments, the nucleotide sequence of the entire dsRNA is not 100% identical or complementary to the RNA Trigger Sequences or RNA Trigger Sequence Reverse Complements. For example, in some embodiments the dsRNA comprises at least two segments each of 21 contiguous nucleotides with a sequence of 100% identity with a portion of a sequence selected from the RNA Trigger Sequences or RNA Trigger Sequence Reverse Complements, wherein (1) the at least two segments are separated by one or more spacer nucleotides, or (2) the at least two segments are arranged in an order different from that in which the corresponding fragments occur in the target genes.

In some embodiments, the fungicidal double-stranded RNA molecule is between about 50 to about 500 base-pairs in length. In some embodiments, the fungicidal double-stranded RNA molecule comprises at least one segment of at least 30 contiguous nucleotides in length. In some embodiments, the fungicidal double-stranded RNA molecule comprises multiple segments of 18 or more contiguous nucleotides that are essentially identical or essentially complementary to a segment of equivalent length of a target gene or DNA (cDNA) having a sequence selected from The Target Gene Sequences Group, wherein the segments are from different regions of the target gene (e.g., the segments can correspond to different exon regions of the target gene, and "spacer" nucleotides which do not correspond to a target gene can optionally be used in between or adjacent to the segments), or are from different target genes. In some embodiments, the fungicidal double-stranded RNA molecule comprises multiple segments of 18 or more contiguous nucleotides that are essentially identical or essentially complementary to a segment of equivalent length of a target gene or DNA (cDNA) having a sequence selected from The Target Gene Sequences Group, wherein the segments are from different regions of the target gene and are arranged in the fungicidal double-stranded RNA molecule in an order different from the order in which the segments naturally occur in the target gene. In some embodiments, the fungicidal double-stranded RNA molecule comprises multiple segments each of 18 contiguous nucleotides with a sequence of 100% identity or 100% complementary to a segment of equivalent length of a target gene or DNA (cDNA) having a sequence selected from The Target Gene Sequences Group, wherein the segments are from different regions of the target gene and are arranged in the fungicidal double-stranded RNA molecule in an order different from the order in which the segments naturally occur in the target gene. In some embodiments, the fungicidal double-stranded RNA molecule comprises one strand comprising a sequence selected from the group consisting of the Trigger Sequences Group, or the complement thereof.

The fungicidal double-stranded RNA molecule can be topically applied to a plant to control or prevent infection by *E. necator*. The fungicidal double-stranded RNA molecule can be provided in a form suitable for transfection or direct contact by *E. necator*, e.g., in the form of a spray or powder. Other methods and suitable compositions for providing the fungicidal double-stranded RNA molecule are similar to those described in the preceding paragraphs for other aspects of this invention.

Several embodiments relate to a tank mixture comprising one or more fungicidal polynucleotides and water or other solvent, optionally including an organosilicone surfactant. Embodiments include tank mixture formulations of the polynucleotide and optionally at least one pesticidal agent. Embodiments of such compositions include those where one or more fungicidal polynucleotides are provided in a living or dead microorganism such as a bacterium or fungal or yeast cell, or provided as a microbial fermentation product, or provided in a living or dead plant cell, or provided as a synthetic recombinant polynucleotide. In an embodiment the composition includes a non-pathogenic strain of a microorganism that contains a polynucleotide as described herein; intake of the microorganism results in suppression of growth, a decrease in virulence or pathogenicity, or decrease in propagation/reproduction capacity (sporulation), or mortality of *E. necator* on *V. vinifera*; non-limiting examples of suitable microorganisms include *E. coli, B. thuringiensis, Pseudomonas* sp., *Photorhabdus* sp., Xenorhabdus sp., *Serratia entomophila* and related *Serratia* sp., *B. sphaericus, B. cereus, B. laterosporus, B. popilliae, Clostridium bifermentans* and other *Clostridium* species, or other spore-forming gram-positive bacteria. In an embodiment, the composition includes a plant virus vector comprising a polynucleotide as described herein; infection by *E. necator* on a plant treated with the plant virus vector results in suppressed growth, mortality, a decrease in virulence or pathogenicity, or decrease in propagation/reproduction capacity (sporulation) of *E. necator* on *V. vinifera*. In an embodiment, the composition includes a baculovirus vector including a polynucleotide as described herein; intake of the vector results in suppressed growth or mortality, a decrease in virulence or pathogenicity, or decrease in propagation/reproduction capacity (sporulation) of *E. necator* on v. *vinifera*. In an embodiment, a polynucleotide as described herein is encapsulated in a synthetic matrix such as a polymer or attached to particulates and topically applied to the surface of a plant; infection by *E. necator* on the topically treated plant results in suppressed growth, mortality, a decrease in virulence or pathogenicity, or decrease in propagation/reproduction capacity (sporulation) of *E. necator* on v. *vinifera*. In an embodiment, a polynucleotide as described herein is provided in the form of a plant cell (e.g., a transgenic *Vitis vinifera* plant cell of this invention) expressing the polynucleotide; infection of the plant cell or contents of the plant cell by *E. necator* results in suppression, mortality, a decrease in virulence or pathogenicity, or decrease in propagation/reproduction capacity (sporulation) of *E. necator* in v. *vinifera*.

In some embodiments, one or more polynucleotides as described herein are provided with appropriate stickers and wetters required for efficient foliar coverage as well as UV protectants to protect polynucleotides such as dsRNAs from UV damage. In some embodiments, one or more polynucleotides as described herein are further provided with a carrier agent, a surfactant, an organosilicone, an organosilicone surfactant, a polynucleotide herbicidal molecule, a non-polynucleotide herbicidal molecule, a non-polynucleotide pesticide, a polynucleotide pesticide, a non-polynucleotide insecticide, a polynucleotide pesticide, a safener, and a pathogen growth regulator. In some embodiments, the composition further includes at least one pesticidal or fungicidal agent.

Such compositions are applied in any convenient manner, e.g., by spraying or dusting *E. necator* directly, or spraying or dusting a plant (including, for example, the leaves of a plant) or environment wherein prevention or control of infection by *E. necator* is desired, or by applying a coating to a surface of a plant, or by applying a coating to a seed in preparation for the seed's planting, or by applying a soil drench around roots of a plant for which prevention or control of infection by *E. necator* is desired.

An effective amount of a polynucleotide as described herein is an amount sufficient to provide control of *E. necator* (for example by causing mortality, suppressing the growth of, or suppressing or decreasing propagation or reproduction of *E. necator*) or to prevent infection by *E. necator*; determination of effective amounts of a polynucleotide are made using routine assays. While there is no upper limit on the concentrations and dosages of a fungicidal polynucleotide that can be useful in the methods and compositions provided herein, lower effective concentrations and dosages will generally be sought for efficiency and economy. Non-limiting embodiments of effective amounts of a polynucleotide include a range from about 10 nanograms per milliliter to about 100 micrograms per milliliter of a polynucleotide in a liquid form sprayed on a plant, or from about 10 milligrams per acre to about 100 grams per acre of polynucleotide applied to a field of plants. Where polynucleotides as described herein are topically applied to a plant, the concentrations can be adjusted in consideration of the volume of spray or treatment applied to plant leaves or other plant part surfaces, such as flower petals, stems, fruit, anthers, pollen, leaves, roots, or seeds. In one embodiment, a useful treatment for herbaceous plants using 25-mer polynucleotides as described herein is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a ssDNA polynucleotide are applied. In certain embodiments, about 0.5 nmol to about 2 nmol of a dsRNA is applied. In certain embodiments, a composition containing about 0.5 to about 2.0 milligrams per milliliter, or about 0.14 milligrams per milliliter of a dsRNA or an ssDNA (21-mer) is applied. In certain embodiments, a composition of about 0.5 to about 1.5 milligrams per milliliter of a dsRNA polynucleotide of this invention of about 50 to about 200 or more nucleotides is applied. In certain embodiments, about 1 nmol to about 5 nmol of a dsRNA of this invention is applied to a plant. In certain embodiments, the polynucleotide composition as topically applied to the plant contains at least one polynucleotide of this invention at a concentration of about 0.01 to about 10 milligrams per milliliter, or about 0.05 to about 2 milliliters per milliliter, or about 0.1 to about 2 milligrams per milliliter. Very large plants, trees, or vines can require correspondingly larger amounts of polynucleotides. When using long dsRNA molecules of this invention that can be processed into multiple oligonucleotides (e.g., multiple triggers encoded by a single recombinant DNA molecule of this invention), lower concentrations can be used. Non-limiting examples of effective polynucleotide treatment regimens include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

In some embodiments, one or more polynucleotides is provided with a "transfer agent", which is an agent that enables a topically applied polynucleotide to enter the cells of an organism. Such transfer agents can be incorporated as part of a composition comprising a polynucleotide as described herein, or can be applied prior to, contemporaneously with, or following application of the polynucleotide. In some embodiments, a transfer agent is an agent that improves the uptake of a polynucleotide of this invention by *E. necator*. In some embodiments, a transfer agent is an agent that conditions the surface of plant tissue, e.g., seeds, leaves, stems, roots, flowers, or fruits, to permeation by a polynucleotide into plant cells. In some embodiments, the transfer agent enables a pathway for a polynucleotide through cuticle wax barriers, stomata, and/or cell wall or membrane barriers into plant cells.

Suitable transfer agents include agents that increase permeability of the exterior of the organism or that increase permeability of cells of the organism to polynucleotides. Suitable transfer agents include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or any combination thereof. In some embodiments, application of a polynucleotide and a transfer agent optionally includes an incubation step, a neutralization step (e.g., to neutralize an acid, base, or oxidizing agent, or to inactivate an enzyme), a rinsing step, or combinations thereof. Suitable transfer agents can be in the form of an emulsion, a reverse emulsion, a liposome, or other micellar-like composition, or can cause the polynucleotide to take the form of an emulsion, a reverse emulsion, a liposome, or other micellar-like composition. Embodiments of transfer agents include counter-ions or other molecules that are known to associate with nucleic acid molecules, e.g., inorganic ammonium ions, alkyl ammonium ions, lithium ions, polyamines such as spermine, spermidine, or putrescine, and other cations. Embodiments of transfer agents include organic solvents such as DMSO, DMF, pyridine, N-pyrrolidine, hexamethylphosphoramide, acetonitrile, dioxane, polypropylene glycol, or other solvents miscible with water or that dissolve phosphonucleotides in non-aqueous systems (such as is used in synthetic reactions). Embodiments of transfer agents include naturally derived or synthetic oils with or without surfactants or emulsifiers, e.g., plant-sourced oils, crop oils (such as those listed in the $9^{th}$ Compendium of Herbicide Adjuvants, publicly available on-line at herbicide-.adjuvants.com), paraffinic oils, polyol fatty acid esters, or oils with short-chain molecules modified with amides or polyamines such as polyethyleneimine or N-pyrrolidine.

Embodiments of transfer agents include organosilicone preparations. For example, a suitable transfer agent is an organosilicone preparation that is commercially available as SILWET L-77® brand surfactant having CAS Number 27306-78-1 and EPA Number: CAL.REG.NO. 5905-50073-AA, and currently available from Momentive Performance Materials, Albany, N.Y. BREAK-THRU S 240 brand a Polyether Modified Polysiloxane (CASRN Proprietary) surfactant, currently available from Goldschmidt Chemical Corporation, Hopewell, VA BREAK-THRU S 279 an end capped polyether trisiloxane surfactant, which components are listed in the following chemical inventories: EINECS, TSCA, ENCS, AICS, ECL, PICCS CHINA, NDSL. INDUCE brand adjuvant NMFC Item 42652, Class 60, currently available from Helena Chemical Company, Collierville, TN FRANCHISE® with LECI-TECH® brand surfactant having a CA REG No. 34704-50065, currently available from Loveland Products, Inc. Greely, CO One embodiment includes a composition that comprises a polynucleotide and BREAK-thru 301. One embodiment includes a composition that comprises a polynucleotide and a transfer agent including an organosilicone preparation such as Silwet L-77, Break-thru S240, Break-thru S279, Induce or Franchise in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent). One embodiment includes a composition that comprises a polynucleotide of this invention and a transfer agent including SILWET L-77®, BREAK-THRU S240, BREAK-THRU S279, Induce or Franchise brand surfactants in the range of about 0.3 to about 1 percent by weight (wt percent) or about 0.5 to about 1%, by weight (wt percent).

Organosilicone compounds useful as transfer agents for use in this invention include, but are not limited to, compounds that include: (a) a trisiloxane head group that is covalently linked to, (b) an alkyl linker including, but not limited to, an n-propyl linker, that is covalently linked to, (c) a polyglycol chain, that is covalently linked to, (d) a terminal group. Trisiloxane head groups of such organosilicone compounds include, but are not limited to, heptamethyltrisiloxane. Alkyl linkers can include, but are not limited to, an n-propyl linker. Polyglycol chains include, but are not limited to, polyethylene glycol or polypropylene glycol. Polyglycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Organosilicone compounds useful as transfer agents include, but are not limited to, trisiloxane ethoxylate surfactants or polyalkylene oxide modified heptamethyl trisiloxane. An example of a transfer agent for use in this invention is Compound I:

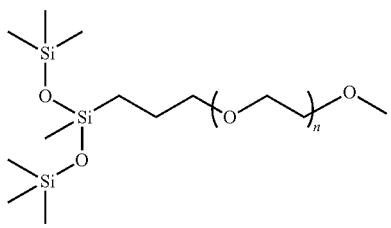

Organosilicone compounds useful as transfer agents are used, e.g., as freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent).

Embodiments of transfer agents include one or more salts such as ammonium chloride, tetrabutylphosphonium bromide, and ammonium sulfate, provided in or used with a composition including a polynucleotide. In some embodiments, ammonium chloride, tetrabutylphosphonium bromide, and/or ammonium sulfate are used at a concentration of about 0.5% to about 5% (w/v), or about 1% to about 3% (w/v), or about 2% (w/v). In certain embodiments, the composition including a polynucleotide includes an ammonium salt at a concentration greater or equal to 300 millimolar. In certain embodiments, the composition including a polynucleotide includes an organosilicone transfer agent in a concentration of about 0.015 to about 2 percent by weight (wt percent) as well as ammonium sulfate at concentrations from about 80 to about 1200 mM or about 150 mM to about 600 mM.

Embodiments of transfer agents include a phosphate salt. Phosphate salts useful in a composition including a polynucleotide include, but are not limited to, calcium, magnesium, potassium, or sodium phosphate salts. In certain embodiments, a composition including a polynucleotide includes a phosphate salt at a concentration of at least about 5 millimolar, at least about 10 millimolar, or at least about 20 millimolar. In certain embodiments, a composition including a polynucleotide a phosphate salt in a range of about 1 mM to about 25 mM or in a range of about 5 mM to about 25 mM. In certain embodiments, the composition including a polynucleotide sodium phosphate at a concentration of at least about 5 millimolar, at least about 10 millimolar, or at least about 20 millimolar. In certain embodiments, a composition including a polynucleotide includes sodium phosphate at a concentration of about 5 millimolar, about 10 millimolar, or about 20 millimolar. In certain embodiments, a composition including a polynucleotide includes a sodium phosphate salt in a range of about 1 mM to about 25 mM or in a range of about 5 mM to about 25 mM. In certain embodiments, a composition including a polynucleotide includes a sodium phosphate salt in a range of about 10 mM to about 160 mM or in a range of about 20 mM to about 40 mM. In certain embodiments, a composition including a polynucleotide includes a sodium phosphate buffer at a pH of about 6.8.

Embodiments of transfer agents include surfactants and/or effective molecules contained therein. Surfactants and/or effective molecules contained therein include, but are not limited to, sodium or lithium salts of fatty acids (such as tallow or tallowamines or phospholipids) and organosilicone surfactants. In certain embodiments, a composition including a polynucleotide is formulated with counter-ions or other molecules that are known to associate with nucleic acid molecules. Non-limiting examples include, tetraalkyl ammonium ions, trialkyl ammonium ions, sulfonium ions, lithium ions, and polyamines such as polyethyleneimine, spermine, spermidine, or putrescine. In certain embodiments, a composition including a polynucleotide is formulated with a non-polynucleotide herbicide e.g., glyphosate, auxin-like benzoic acid herbicides including dicamba, chloramben, and TBA, glufosinate, auxin-like herbicides including phenoxy carboxylic acid herbicide, pyridine carboxylic acid herbicide, quinoline carboxylic acid herbicide, pyrimidine carboxylic acid herbicide, and benazolin-ethyl herbicide, sulfonylureas, imidazolinones, bromoxynil, dalapon, cyclohezanedione, protoporphyrinogen oxidase inhibitors, and 4-hydroxyphenyl-pyruvate-dioxygenase inhibiting herbicides.

IX. Fungicidal Compositions for Controlling *E. necator* Infection

Another aspect of this invention provides a fungicidal composition for controlling *E. necator* comprising a fungicidally effective amount of at least one RNA. Such RNAs may be any of the RNAs described in section III or elsewhere herein. In an embodiment, the RNA comprises at least one segment of 18 or more 19 or more, 20 or more, 21 or more, 22 or more, 23 or more, 24 or more, 25 or more, 30 or more, 50 or more, 75 or more, 100 or more, 125 or more, 150 or more, 200 or more, 250 or more, 300 or more, 400 or more, 500 or more, 600 or more, 700 or more, 800 or more, 900 or more, or 1,000 or more contiguous nucleotides of about 75% to about 100% identity, about 80% to about 100% identity, about 85% to about 100% identity, about 90% to about 100% identity, about 95% to about 100% identity, about 98% to about 100% identity, about 100% identity, or exactly 100% identity with a corresponding fragment of a DNA or a target gene having a sequence selected from the group consisting of: the Target Gene Sequences Group, or the DNA complement thereof or an RNA transcribed therefrom. In an embodiment, the RNA comprises a nucleotide sequence that is essentially complementary to at least 18, at least 19, at least 20, at least 21, at least 22, at least 23, at least 24, at least 25, at least 30, at least 50, at least 75, at least 100, at least 125, at least 150, at least 200, at least 250, at least 300, at least 400, at least 500, at least 600, at least 700, at least 800, at least 900, or at least 1,000 contiguous nucleotides of a target gene having a nucleotide sequence selected from the group consisting of SEQ ID NOs:1-107 and 492-642 or the DNA complement thereof or an RNA transcribed from such target gene.

In some embodiments, the RNA comprises a sequence essentially complementary to or about 75% to about 100%, about 80% to about 100%, about 85% to about 100%, about 90% to about 100%, 95% to about 100%, about 98% to about 100%, about 100%, or 100% identical to at least 18, at least 19, at least 20, at least 21, at least 22, at least 23, at least 24, at least 25, at least 50, at least 75, at least 100, at least 150, at least 200, at least 300, at least 400, or at least 500 contiguous nucleotides of a sequence selected from the group consisting of SEQ ID NOs: 215-321, 857-1070, 322-428, and 1071-1284, or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments, the polynucleotide comprises a sequence essentially complementary to or at least about 75%, at least about 80%, at least about 85%, at least about 90%, at least about 95%, at least about 98%, about 100%, or exactly 100% identical to a sequence selected from the RNA Trigger Sequences or the RNA Trigger Sequences Reverse Complements or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256. In some embodiments the polynucleotide comprises a nucleotide sequence selected from a group consisting of SEQ ID Nos 215-321, 857-1070, 322-428, and 1071-1284, or selected from the group consisting of SEQ ID NOs: 215, 216, 246, 249, 251, 275, 281, 288, 299, 302, 320, 983, 1042, 322, 323, 353, 356, 358, 382, 388, 395, 406, 409, 427, 1197, and 1256

In this context "controlling" includes inducement of a biological change in E. necator such as, but not limited to, increased mortality, suppressed growth, a decrease in virulence and/or pathogenicity, or decrease in propagation/reproduction capacity (sporulation). By "fungicidally effective amount" is meant an amount of an agent effective in inducing a biological change in E. necator such as, but not limited to, increased mortality, suppressed growth, reduction in virulence and/or pathogenicity, and decrease in propagation/reproductive capacity; in some embodiments, application of a fungicidally effective amount of the RNA to a plant improves the plant's resistance to infection by E. necator. The RNA can be longer than the segment or segments it contains (i.e. the RNA may contain additional nucleotides 3' and/or 5' of the segment), but each segment and corresponding fragment of a target gene are of equivalent length. RNAs of use in the method can be designed for multiple target genes. Embodiments include those in which the fungicidal composition comprises a fungicidally effective amount of a polynucleotide comprising at least 18, 19, 20, or 21 contiguous nucleotides that are complementary to a portion of a target gene having a nucleotide sequence selected from the Target Genes Sequences Group, or an RNA transcribed from the target gene; or a fungicidally effective amount of at least one polynucleotide comprising at least one silencing element that is essentially complementary or essentially identical to at least 21 contiguous nucleotides of a target gene or an RNA transcribed from the target gene, wherein the target gene has a nucleotide sequence selected from the Target Gene Sequences Group; or a fungicidally effective amount of at least one RNA comprising at least one segment that is identical or complementary to at least 18, 19, 20, or 21 contiguous nucleotides of a target gene having a nucleotide sequence of SEQ ID NO:1, or an RNA transcribed from the target gene; or an RNA molecule that causes mortality, suppression of growth, a decrease in virulence or pathogenicity, or decrease in propagation/reproduction capacity (sporulation) in E. necator on v. vinifera, when transfected into or contacted by E. necator, wherein the RNA molecule comprises at least 18, 19, 20, or 21 contiguous nucleotides that are complementary to a portion of a target gene having a nucleotide sequence of SEQ ID NO:1, or an RNA transcribed from the target gene; or a fungicidal double-stranded RNA molecule that causes mortality, suppression of growth, a decrease in virulence and/or pathogenicity or decrease in propagation/reproduction capacity (sporulation) in E. necator when transfected into or contacted by E. necator, wherein at least one strand of the fungicidal double-stranded RNA molecule comprises 21 contiguous nucleotides that are complementary to a portion of a target gene or an RNA transcribed from the target gene, wherein the target gene has a sequence of SEQ ID NO:1; or a fungicidally effective amount of at least one double-stranded RNA comprising a sequence selected from the Trigger Sequences Group. In some embodiments, the polynucleotide is a double-stranded RNA. In some embodiments, the polynucleotide (e.g., double-stranded RNA) is chemically or enzymatically synthesized or is produced by expression in a microorganism or by expression in a plant cell. Embodiments include fungicidal compositions comprising a dsRNA having a sequence selected from the Trigger Sequences Group, the RNA Trigger Sequences Group, the RNA Trigger Sequences Reverse Complement Group, or selected from the group consisting of SEQ ID NOs: 108, 109, 139, 142, 144, 168, 174, 181, 192, 195, 213, 769, 828, 215, 216, 246, 249, 251, 275, 281, 288, 299, 302, 320, 983, 1042, 322, 323, 353, 356, 358, 382, 388, 395, 406, 409, 427, 1197, and 1256, or in a more specific embodiment, SEQ ID NO: 215 or the complement thereof.

In various embodiments, the fungicidal composition for controlling E. necator is in the form of at least one selected from the group consisting of a solid, liquid (including homogeneous mixtures such as solutions and non-homogeneous mixtures such as suspensions, colloids, micelles, and emulsions), powder, suspension, emulsion, aerosol, encapsulated or micro-encapsulation formulation, in or on microbeads or other carrier particulates, in a film or coating, or on or within a matrix, or as a leaf, seed, root, or stem treatment. Suitable binders, inert carriers, surfactants, and the like can optionally be included in the polynucleotide-containing composition, as is known to one skilled in formulation of fungicides and seed, stem, fruit, or foliar treatments. E. necator to be controlled is generally a pathogen that infects a plant. In some embodiments the plant is grape plant. In some embodiments, the fungicidal composition is at least one implantable formulation selected from the group consisting of a particulate, pellet, or capsule implanted in the plant; in such embodiments the method comprises implanting in the plant the implantable formulation. In one embodiment the fungicidal composition can be transfected or otherwise absorbed internally by E. necator. In some embodiments, the fungicidal composition further comprises one or more components selected from the group consisting of a carrier agent, a surfactant, an organosilicone, an organosilicone surfactant, a polynucleotide herbicidal molecule, a non-polynucleotide herbicidal molecule, a non-polynucleotide pesticide, a poly-nucleotide pesticide, and a safener, a pathogen growth regulator. In one embodiment the fungicidal composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. One embodiment includes a fungicidal composition that further comprises a BREAK-thru 301. Other surfactants include, for example, BREAK-THRU S 240 brand, a Polyether Modified Polysiloxane (CASRN Proprietary) surfactant, currently available from Goldschmidt Chemical Corporation, Hopewell, VA; BREAK-THRU S 279, an end capped polyether trisiloxane surfactant, which components are listed in the following chemical inventories: EINECS, TSCA, ENCS, AICS, ECL, PICCS CHINA, NDSL; INDUCE brand adjuvant NMFC Item 42652, Class 60, currently available from Helena Chemical Company, Collierville, TN FRANCHISE® with LECI-TECH® brand surfactant having a CA REG No. 34704-50065, currently available from Loveland Products, Inc. Greely, CO Alternatively, the plant is topically treated with the fungicidal composition as well as with a separate (preceding, following, or concurrent) application of a substance that improves the efficacy of the fungicidal composition. For example, a plant can be sprayed with a first topical application of a solution containing a nonionic organosilicone surfactant such as SILWET® brand surfactants, e.g., SILWET L-77®, BREAK-THRU S24, BREAK-THRU S279, INDUCE or FRANCHISE brand surfactants, followed by a second topical application of the fungicidal composition, or vice versa.

It is anticipated that the combination of certain RNAs of use in this method (e.g., the dsRNA triggers described in the working Examples) with one or more non-polynucleotide fungicidal agents will result in an enhanced improvement in prevention or control of *E. necator* infections, when compared to the effect obtained with the RNA alone or the non-polynucleotide fungicidal agent alone.

In various embodiments, the fungicidal composition comprises a microbial cell or is produced in a microorganism. For example, the fungicidal composition can include or can be produced in bacteria or yeast cells. In similar embodiments the fungicidal composition comprises a transgenic plant cell or is produced in a plant cell (for example a plant cell transiently expressing the polynucleotide); such plant cells can be cells in a plant or cells grown in tissue culture or in cell suspension.

In one embodiment the fungicidal composition is provided in the form of any plant that is subject to infection by *E. necator*, wherein the RNA is contained in or on the plant. Such plants can be stably transgenic plants that express the RNA, or non-transgenic plants that transiently express the RNA or that have been treated with the RNA, e.g., by spraying or coating. Stably transgenic plants generally contain integrated into their genome a recombinant construct that encodes the RNA.

The RNA useful in the fungicidal composition can be single-stranded (ss) or double-stranded (ds). Embodiments include those wherein the RNA is at least one selected from the group consisting of sense single-stranded RNA (ssRNA), anti-sense single-stranded (ssRNA), or double-stranded RNA (dsRNA); a mixture of RNAs of any of these types can be used. In one embodiment a double-stranded DNA/RNA hybrid is used. The RNA can include components other than standard ribonucleotides, e.g., an embodiment is an RNA that comprises terminal deoxyribonucleotides.

The RNA in the fungicidal composition has at least one segment of 18 or more contiguous nucleotides with a sequence of about 95% to about 100% identity with a fragment of equivalent length of a target gene or DNA having a sequence selected from the Target Gene Sequences Group, or the DNA complement thereof. In an embodiment the RNA comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the Target Gene Sequences Group, or the DNA complement thereof. In some embodiments the contiguous nucleotides are exactly (100%) identical to a fragment of equivalent length of a DNA having a sequence selected from the Target Gene Sequences Group, or the DNA complement thereof. In some embodiments, the RNA has an overall sequence of about 95%, about 96%, about 97%, about 98%, about 99%, or about 100% identity with a fragment of a DNA having a sequence selected from the Target Gene Sequences Group, or the DNA complement thereof.

The RNA in the fungicidal composition comprises at least one segment of 18 or more contiguous nucleotides with a sequence of about 95% to about 100% identity with a fragment of equivalent length of a DNA having a sequence selected from the Target Gene Sequences Group or the DNA complement thereof. In some embodiments the RNA comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the RNA comprises at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof. In particular embodiments, the RNA is a double-stranded nucleic acid (e.g., dsRNA) with one strand comprising at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 18, 19, 20, or 21 contiguous, perfectly matched base-pairs which correspond to a fragment of equivalent length of a DNA or target gene having a sequence selected from the Target Gene Sequences Group or the DNA complement thereof. In particular embodiments, each segment contained in the RNA is of a length greater than that which is typical of naturally occurring regulatory small RNAs, e.g., each segment is at least about 30 contiguous nucleotides (or base-pairs) in length. In some embodiments, the total length of the RNA, or the length of each segment contained in the RNA, is less than the total length of the sequence of interest (DNA or target gene having a sequence selected from the group consisting of the Target Gene Sequences Group). In some embodiments, the total length of the RNA is between about 50 to about 500 nucleotides (for single-stranded RNAs) or base-pairs (for double-stranded RNAs). In some embodiments, the RNA comprises at least one RNA strand of between about 50 to about 500 nucleotides in length.

The RNA in the fungicidal composition is generally designed to suppress one or more genes ("target genes"). Such target genes can include coding or non-coding sequence or both. In specific embodiments, the RNA is designed to suppress one or more target genes, where each target gene has a DNA sequence selected from the group consisting of the Target Gene Sequences Group. In various embodiments, the RNA is designed to suppress one or more genes, where each gene has a sequence selected from the group consisting of the Target Gene Sequences Group and can be designed to suppress multiple genes from this group, or to target different regions of one or more of these genes. In an embodiment, the RNA comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence and can be sense or anti-sense relative to the target gene. For example, in one embodiment the RNA can include multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof; the segments can be from different regions of the target gene, e.g., the segments can correspond to different exon regions of the target gene, and "spacer" nucleotides which do not correspond to a target gene can optionally be used in between or adjacent to the segments.

The total length of the RNA in the fungicidal composition can be greater than 18 contiguous nucleotides and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the RNA can be greater than the length of the section or segment of the RNA designed to suppress one or more target genes, where each target gene has a DNA sequence selected from the group consisting of the Target Gene Sequences Group. For example, the RNA can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the RNA comprises additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the RNA comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the RNA comprises one such segment, with an additional 5' G or an additional 3' C or both, adjacent to the segment. In another embodiment, the RNA is a double-stranded RNA comprising additional nucleotides to form an overhang, for example, a dsRNA comprising 2 deoxyribonucleotides to form a 3' overhang. Thus, in various embodiments, the nucleotide sequence of the entire RNA is not 100% identical or complementary to a fragment of contiguous nucleotides in the DNA or target gene having a sequence selected from the group consisting of the Target Gene Sequences Group. For example, in some embodiments the RNA comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In various embodiments the RNA in the fungicidal composition is comprised of naturally occurring ribonucleotides. Embodiments include, for example, synthetic RNAs consisting wholly of ribonucleotides or mainly of ribonucleotides but with one or more terminal deoxyribonucleotides or one or more terminal dideoxyribonucleotides. In certain embodiments, the RNA comprises non-canonical nucleotides such as inosine, thiouridine, or pseudouridine. In certain embodiments, the RNA comprises chemically modified nucleotides. (a) The RNA in the fungicidal composition is provided by suitable means known to one in the art.

In some embodiments the RNA is provided as an isolated RNA that is not part of an expression construct. In some embodiments the RNA is provided as an isolated RNA that is lacking additional elements such as a promoter or terminator sequences. Such RNAs can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively, the RNA can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as including additional RNA encoding an aptamer or ribozyme or an expression cassette for expressing a gene of interest (e.g., a fungicidal protein).

X. Methods of Providing Plants Having Improved Resistance to *E. necator* Infection, and the Plants, Plant Parts, and Seeds Thus Provided Several embodiments relate to a method of providing a plant having improved resistance to *E. necator* infection comprising providing to the plant at least one polynucleotide comprising at least one segment of 18 or more contiguous nucleotides that is essentially identical or complementary to a fragment of a target gene selected from the group consisting of the genes identified in the Target Gene Sequences Group.

In an embodiment, this invention provides a method of providing a plant having improved resistance to *E. necator* infection comprising providing to the plant at least one polynucleotide comprising at least one segment that is identical or complementary to at least 18 contiguous nucleotides of a target gene or an RNA transcribed from the target gene, wherein the target gene is selected from the genes identified in the Target Gene Sequences Group or an RNA transcribed from the target gene. Embodiments of these target genes are identified by name in Table 1 and include genes having a sequence selected from the group consisting of the Target Gene Sequences Group, as well as related genes, including orthologs from related phytopathogenic fungi. In some embodiments, the polynucleotide (e.g., double-stranded RNA) is chemically or enzymatically synthesized or is produced by expression in a microorganism or by expression in a plant cell. In some embodiments the polynucleotide comprises at least one segment of 18 or more contiguous nucleotides that is essentially identical or complementary to a sequence selected from the group consisting of the Target Gene Sequences Group. In some embodiments the polynucleotide is a dsRNA with a strand having a sequence selected from the Trigger Sequences Group, or the complement thereof. In some embodiments the polynucleotide comprises a dsRNA with a strand having a sequence selected from the Trigger Sequences Group.

In a related aspect, this invention is directed to the plant having improved resistance to *E. necator* infection, provided by expressing in the plant at least one polynucleotide comprising at least one segment of 18 or more contiguous nucleotides that are essentially identical or complementary to a fragment of equivalent length of a target gene selected from the group consisting of the genes identified in the Target Gene Sequences Group, whereby the resulting plant has improved resistance to *E. necator* infection when compared to a control plant in which the polynucleotide is not expressed. In a related aspect, this invention is directed to the plant having improved resistance to *E. necator* infection, provided by expressing in the plant at least one polynucleotide comprising at least one segment of 18 or more contiguous nucleotides with a sequence of about 95% to about 100% identity with or complementarity to a fragment of a target gene selected from the group consisting of the genes identified in the Target Gene Sequences Group, whereby the resulting plant has improved resistance to *E. necator* infection when compared to a control plant in which the polynucleotide is not expressed.

In yet another aspect, this invention is directed to seed or propagatable parts (especially transgenic progeny seed or propagatable parts) produced by the plant having improved resistance to *E. necator* infection, as provided by this method. Also contemplated is a commodity product produced by the plant having improved resistance to *E. necator* infection, as provided by this method, and a commodity product produced from the transgenic progeny seed or propagatable parts of such a plant.

Another aspect of this invention provides a method of providing a plant having improved resistance to *E. necator* infection comprising topical application to the plant a composition comprising at least one polynucleotide having at least one segment of 18 or more contiguous nucleotides with a sequence of about 95% to about 100% identity with a fragment of a target gene or DNA having a sequence selected from The Target Gene Sequences Group, or the DNA complement thereof, in a manner such that the plant treated with the polynucleotide-containing composition exhibits improved resistance to *E. necator* infection, relative to an untreated plant. In an embodiment, the at least one polynucleotide comprises at least one segment of 18 or more contiguous nucleotides that are essentially identical to a fragment of equivalent length of a DNA having a sequence selected from the Target Gene Sequences Group, or the DNA complement thereof. The polynucleotide can be longer than the segment or segments it contains, but each segment and corresponding fragment of a target gene are of equivalent length. In an embodiment, this invention provides a method of providing a plant having improved resistance to *E. necator* infection comprising topical application to the plant a composition comprising at least one polynucleotide comprising a nucleotide sequence that is complementary to at least 18 contiguous nucleotides of a target gene having a nucleotide sequence selected from the group consisting of: SEQ ID NO:1, or an RNA transcribed from the target gene. In an embodiment, this invention provides a method of providing a plant having improved resistance to *E. necator* infection comprising topically applying to the plant a composition comprising at least one polynucleotide in a manner such that an effective amount of the polynucleotide is transfected into *E. necator* in or on the plant, the polynucleotide comprising at least 18 contiguous nucleotides that are complementary to a region of a target gene having a nucleotide sequence SEQ ID NO:1, or an RNA transcribed from the target gene.

Polynucleotides of use in the method can be designed for multiple target genes. Embodiments include those in which the composition comprises a dsRNA with a strand having a sequence selected from the group consisting of the Trigger Sequences Group. Related aspects of the invention include compositions for topical application and isolated polynucleotides of use in the method, and plants having improved *E. necator* resistance provided by the method.

By "topical application" as used throughout herein is meant application to the surface or exterior of an object, such as the surface or exterior of a plant, such as application to the surfaces of a plant part such as a leaf, stem, flower, fruit, shoot, root, stem, seed, flowers, anthers, or pollen, or application to an entire plant, or to the above-ground or below-ground portions of a plant. Topical application can be carried out on non-living surfaces, such as application to soil, or to a surface or matrix by which *E. necator* can encounter the polynucleotide. In various embodiments of the method, the composition comprising at least one polynucleotide is topically applied to the plant in a suitable form, e.g., as a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a leaf, seed, root, or stem treatment. In some embodiments of the method, the polynucleotide-containing composition is topically applied to above-ground parts of the plant, e.g., sprayed or dusted onto leaves, stems, and flowering parts of the plant.

Embodiments of the method include topical application of a foliar spray (e.g., spraying a liquid polynucleotide-containing composition on leaves of a *V. vinifera* plant) or a foliar dust (e.g., dusting a grape plant with a polynucleotide-containing composition in the form of a powder or on carrier particulates). In other embodiments, the polynucleotide-containing composition is topically applied to below-ground parts of the plant, such as to the roots, e.g., by means of a soil drench. In other embodiments, the polynucleotide-containing composition is topically applied to a seed that is grown into the plant. The topical application can be in the form of topical treatment of fruits of grape plants or seeds from fruits of grape plants. Suitable binders, inert carriers, surfactants, and the like can optionally be included in the polynucleotide-containing composition, as is known to one skilled in formulation of fungicides and seed or stem treatments.

In some embodiments, the polynucleotide-containing composition is at least one topically implantable formulation selected from the group consisting of a particulate, pellet, or capsule topically implanted in the plant; in such embodiments the method comprises topically implanting in the plant the topically implantable formulation. In one embodiment the polynucleotide-containing composition can be transfected or otherwise absorbed internally by *E. necator*. In some embodiments, the polynucleotide-containing composition further comprises a carrier agent and/or a surfactant (e.g. nonionic surfactants). Examples of nonionic organosilicone surfactants include SILWET® brand surfactants BREAK THRU S240, BREAK THRU S279, BREAK THRU 301, induce and Franchise, e.g., SILWET L-77® brand surfactant. A first topical application of the surfactant may be followed by a second topical application of the polynucleotide-containing composition, or vice versa. In some embodiments the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants BREAK THRU S240, BREAK THRU S279, BREAK THRU 301, Induce and Franchise, e.g., SILWET L-77® brand surfactant, followed by a second topical application of the polynucleotide-containing composition, or vice versa.

It is anticipated that the combination of certain polynucleotides useful in the polynucleotide-containing composition (e.g., the polynucleotide triggers described in the working Examples) with one or more non-polynucleotide pesticidal agents will result in an enhanced improvement in prevention or control of *E. necator* infections, when compared to the effect obtained with the polynucleotide alone or the non-polynucleotide pesticidal agent alone In many embodiments the polynucleotide useful in the polynucleotide-containing composition is provided as an isolated DNA or RNA fragment. In some embodiments the polynucleotide useful in the polynucleotide-containing composition is not part of an expression construct and is lacking additional elements such as a promoter or terminator sequences). Such polynucleotides can be relatively short, such as single- or double-stranded polynucleotides of between about 18 to about 300 or between about 50 to about 500 nucleotides (for single-stranded polynucleotides) or between about 18 to about 300 or between about 50 to about 500 base-pairs (for double-stranded polynucleotides). In some embodiments, the polynucleotide is a dsRNA of between about 100 to about 500 base-pairs, such as a dsRNA of the length of any of the dsRNA triggers disclosed in Figures and Table 1. Alternatively, the polynucleotide can be provided in more complex constructs, e.g., as part of a recombinant expression construct, or included in a recombinant vector, for example in a recombinant plant virus vector or in a recombinant baculovirus vector. Such recombinant expression constructs or vectors can be designed to include additional elements, such as expression cassettes for expressing a gene of interest (e.g., a fungicidal protein).

The polynucleotide useful in the polynucleotide-containing composition has at least one segment of 18 or more contiguous nucleotides with a sequence of about 95% to about 100% identity with a fragment of equivalent length of a DNA having a sequence selected from the Target Gene Sequences Group or the DNA complement thereof. In an embodiment the polynucleotide comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the Target Gene Sequences Group, or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the polynucleotide has an overall sequence of about 95%, about 96%, about 97%, about 98%, about 99%, or about 100% identity with a fragment of a DNA having a sequence selected from the Target Gene Sequences Group or the DNA complement thereof.

The polynucleotide useful in the polynucleotide-containing composition comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the polynucleotide comprises at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof. In particular embodiments, the polynucleotide is a double-stranded nucleic acid (e.g., dsRNA) with one strand comprising at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof expressed as base-pairs, such a double-stranded nucleic acid comprises at least one segment of at least 18, 19, 20, or 21 contiguous, perfectly matched base-pairs which correspond to a fragment of equivalent length of a DNA or target gene having a sequence selected from the Target Gene Sequences Group or the DNA complement thereof. In particular embodiments, each segment contained in the polynucleotide is of a length greater than that which is typical of naturally occurring regulatory small RNAs, e.g., each segment is at least about 30 contiguous nucleotides (or base-pairs) in length. In some embodiments, the total length of the polynucleotide, or the length of each segment contained in the polynucleotide, is less than the total length of the sequence of interest (DNA or target gene having a sequence selected from the group consisting of the Target Gene Sequences Group). In some embodiments, the total length of the polynucleotide is between about 50 to about 500 nucleotides (for single-stranded polynucleotides) or base-pairs (for double-stranded polynucleotides). In some embodiments, the polynucleotide is a dsRNA of between about 100 to about 500 base-pairs, such as a dsRNA of the length of any of the dsRNA triggers disclosed in the Figures and Table 1. In some embodiments, the polynucleotide is dsRNA encoded by a sequence of SEQ ID NO: 108.

The topically applied polynucleotide is generally designed to suppress one or more genes ("target genes"). Such target genes can include coding or non-coding sequence or both. In specific embodiments, the polynucleotide is designed to suppress one or more target genes, where each target gene has a DNA sequence selected from the group consisting of the Target Gene Sequences Group. In various embodiments, the topically applied polynucleotide is designed to suppress one or more genes, where each gene has a sequence selected from the group consisting of the Target Gene Sequences Group, and can be designed to suppress multiple genes from this group, or to target different regions of one or more of these genes. In an embodiment, the topically applied polynucleotide comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence and can be sense or anti-sense relative to the target gene. For example, in one embodiment the topically applied polynucleotide can include multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group.

The total length of the topically applied polynucleotide can be greater than 18 contiguous nucleotides and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the topically applied polynucleotide can be greater than the length of the section or segment of the polynucleotide designed to suppress one or more target genes, where each target gene has a DNA sequence selected from the group consisting of the Target Gene Sequences Group. For example, the topically applied polynucleotide can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the topically applied polynucleotide comprises additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing.

In an embodiment, the topically applied polynucleotide comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the topically applied polynucleotide comprises one such segment, with an additional 5' G or an additional 3' C or both, adjacent to the segment. In another embodiment, the topically applied polynucleotide is a double-stranded RNA comprising additional nucleotides to form an overhang, for example, a dsRNA comprising 2 deoxyribonucleotides to form a 3' overhang. Thus, in various embodiments, the nucleotide sequence of the entire topically applied polynucleotide is not 100% identical or complementary to a fragment of contiguous nucleotides in the DNA or target gene having a sequence selected from the group consisting of the Target Gene Sequences Group. For example, in some embodiments the topically applied polynucleotide comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In a related aspect, this invention is directed to the plant having improved resistance to *E. necator* infection, provided by this method which comprises topically applying to the plant a composition comprising at least one polynucleotide having at least one segment of 18 or more contiguous nucleotides with a sequence of about 95% to about 100% identity with a fragment of equivalent length of a DNA having a sequence selected from the Target Gene Sequences Group or the DNA complement thereof, whereby the plant treated with the polynucleotide composition exhibits improved resistance to *E. necator* infection, relative to an untreated plant.

An embodiment is a grape plant having improved resistance to *E. necator* infection when compared to a control plant, provided by topically applying to the plant or to a seed grown into the plant a dsRNA trigger having a sequence selected from the Trigger Sequences Group, or the complement thereof, or a dsRNA trigger encoded by a sequence SEQ ID NO: 108. In yet another aspect, this invention is directed to seed (especially transgenic progeny seed) produced by the plant having improved resistance to *E. necator* infection, as provided by this method. Also contemplated is a commodity product produced by the plant having improved resistance to *E. necator* infection, as provided by this method, and a commodity product produced from the transgenic progeny seed or stem of such a plant.

XI. Methods of Providing Transgenic Plants Having Improved Resistance to *E. necator* Infections, and the Plants and Seeds Thus Provided Another aspect of this invention is directed to a method of providing a plant having improved resistance to *E. necator* infection comprising expressing in the plant at least one polynucleotide comprising at least one segment of 18 or more contiguous nucleotides that is essentially identical or complementary to a fragment of a target gene or DNA having a sequence selected from the group consisting of the Target Gene Sequences Group, whereby the resulting plant has improved resistance to *E. necator* when compared to a control plant in which the polynucleotide is not expressed. In an embodiment, the method comprises expressing in the plant at least one polynucleotide comprising at least one segment of 18 or more contiguous nucleotides with a sequence of about 95% to about 100% identity with a fragment of equivalent length of a target gene or DNA having a sequence selected from the Target Gene Sequences Group or the DNA complement thereof. In an embodiment, the invention provides a method of providing a plant having improved resistance to *E. necator* infection comprising expressing in the plant at least one polynucleotide comprising at least one segment that is identical or complementary to at least 18, 19, 20, or 21 contiguous nucleotides of a DNA having a sequence selected from the group consisting of: SEQ ID NOs:1-107 and 492-642. By "expressing a polynucleotide in the plant" is generally meant "expressing an RNA transcript in the plant", e.g., expressing in the plant an RNA comprising a ribonucleotide sequence that is anti-sense or essentially complementary to at least a fragment of a target gene or DNA having a sequence selected from the group consisting of the Target Gene Sequences Group. Embodiments include those in which the polynucleotide expressed in the plant is an RNA comprising at least one segment having a sequence selected from the Trigger Sequences Group, or the complement thereof. However, the polynucleotide expressed in the plant can also be DNA (e.g., a DNA produced in the plant during genome replication), or the RNA encoded by such DNA. Related aspects of the invention include isolated polynucleotides of use in the method and plants having improved *E. necator* resistance provided by the method.

The method comprises expressing at least one polynucleotide in a plant, wherein the polynucleotide comprises at least one segment of 18 or more contiguous nucleotides that is essentially identical or complementary to a fragment of a target gene or DNA having a sequence selected from the group consisting of the Target Gene Sequences Group. In some embodiments, a first polynucleotide is provided to a plant in the form of DNA (e.g., in the form of an isolated DNA molecule, or as an expression construct, or as a transformation vector), and the polynucleotide expressed in the plant is a second polynucleotide (e.g., the RNA transcript of the first polynucleotide) in the plant. In an embodiment, the polynucleotide is expressed in the plant by transgenic expression, i.e., by stably integrating the polynucleotide into the plant's genome from where it can be expressed in a cell or cells of the plant. In an embodiment, a first polynucleotide (e.g., a recombinant DNA construct comprising a promoter operably linked to DNA comprising at least one segment of 18 or more contiguous nucleotides that is essentially identical or complementary to a fragment of a target gene or DNA having a sequence selected from the group consisting of the Target Gene Sequences Group) is stably integrated into the plant's genome from where secondarily produced polynucleotides (e.g., an RNA transcript comprising the transcript of the segment of 18 or more contiguous nucleotides that is essentially identical or complementary to a fragment of a target gene or DNA having a sequence selected from the group consisting of the Target Gene Sequences Group) are expressed in a cell or cells of the plant. Methods of providing stably transformed plants are provided in the section headed "Making and Using Transgenic Plant Cells and Transgenic Plants".

In another embodiment the polynucleotide expressed in the plant is expressed by transient expression (i.e., expression not resulting from stable integration of a sequence into the plant's genome). In such embodiments the method can include a step of introducing a polynucleotide (e.g., dsRNA or dsDNA) into the plant by routine techniques known in the art. For example, transient expression can be accomplished by infiltration of a polynucleotide solution using a needleless syringe into a leaf or a stem of a plant.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant. In some embodiments, the first polynucleotide is one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ss€), I a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In specific embodiments, a first polynucleotide is introduced into the plant by topical application to the plant of a polynucleotide-containing composition in a suitable form, e.g., as a solid, liquid (including homogeneous mixtures such as solutions and non-homogeneous mixtures such as suspensions, colloids, micelles, and emulsions), powder, suspension, emulsion, spray, encapsulated or microencapsulation formulation, in or on microbeads or other carrier particulates, in a film or coating, or on or within a matrix, or in the form of a treatment of a grape plant leaf, seed, root, or stem. Suitable binders, inert carriers, surfactants, and the like can optionally be included in the composition, as is known to one skilled in formulation of pesticides and seed treatments. In such embodiments, the polynucleotide-containing composition can further include one or more components selected from the group consisting of a carrier agent, a surfactant, an organosilicone, an organosilicone surfactant, a polynucleotide herbicidal molecule, a non-polynucleotide herbicidal molecule, a non-polynucleotide pesticide, polynucleotide pesticide, a safener, and an pathogen growth regulator; in one embodiment the composition further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y., BREAK-THRU S 240 brand is a Polyether Modified Polysiloxane (CASRN Proprietary) surfactant, currently available from Goldschmidt Chemical Corporation, Hopewell, VA BREAK-THRU S 279 is an end capped polyether trisiloxane surfactant, which components are listed in the following chemical inventories: EINECS, TSCA, ENCS, AICS, ECL, PICCS CHINA, NDSL. INDUCE brand adjuvant NMFC Item 42652, Class 60, currently available from Helena Chemical Company, Collierville, TN FRANCHISE® with LECI-TECH® brand surfactant having a CA REG No. 34704-50065, currently available from Loveland Products, Inc. Greely, CO Alternatively such additional components or pesticidal agents can be provided separately, e.g., by separate topical application or by transgenic expression in the plant. Alternatively, the plant is topically treated with the polynucleotide-containing composition as well as with a separate (preceding, following, or concurrent) application of a substance that improves the efficacy of the polynucleotide-containing composition. For example, a plant can be sprayed with a first topical application of a solution containing a nonionic organosilicone surfactant such as SILWET® brand surfactants, e.g., SILWET L-77®, BREAK-THRU S24, BREAK-THRU S279, INDUCE or FRANCHISE brand surfactants, followed by a second topical application of the polynucleotide-containing composition, or vice-versa. One embodiment includes a composition that further comprises BREAK-thru 301.

It is anticipated that the combination of certain polynucleotides of use in this method (e.g., the polynucleotide triggers described in the working Examples) with one or more non-polynucleotide fungicidal agents will result in an enhanced improvement in prevention or control of *E. necator* infections, when compared to the effect obtained with the polynucleotide alone or the non-polynucleotide fungicidal agent alone.

In some embodiments where the polynucleotide expressed in the plant is expressed by transient expression, a first polynucleotide is provided to a plant in the form of RNA or DNA or both RNA and DNA, and a secondarily produced second polynucleotide is transiently expressed in the plant; the site of application of the first polynucleotide need not be the same site where the second polynucleotide is transiently expressed. For example, a first polynucleotide can be provided to a plant by topical application onto a leaf, or by injection into a stem, and the second polynucleotide can be transiently expressed elsewhere in the plant, e.g., in the roots or throughout the plant. In some embodiments of the method, a composition comprising at least one polynucleotide is topically applied to above-ground parts of the plant, e.g., sprayed or dusted onto leaves, stems, and flowering parts of the plant. In other embodiments, a composition comprising at least one polynucleotide is topically applied to below-ground parts of the plant, such as to the roots, e.g., by means of a soil drench. In other embodiments, a composition comprising at least one polynucleotide is topically applied to a seed that is grown into the plant having improved resistance to *E. necator* infection. In some embodiments the polynucleotide expressed in the plant is RNA, which can be single-stranded (ss) or double-stranded (ds) RNA or a combination of both.

In some embodiments a first polynucleotide (DNA or RNA or both) is provided to a plant and a second polynucleotide having a sequence corresponding (identical or complementary) to the first polynucleotide is subsequently expressed in the plant. In such embodiments the polynucleotide expressed in the plant is an RNA transcript which can be ssRNA or dsRNA or a combination of both. In some embodiments where the polynucleotide is expressed by transient expression, a first polynucleotide is provided to a plant in the form of RNA or DNA or both RNA and DNA, and a secondarily produced second polynucleotide is transiently expressed in the plant; in such embodiments, the first polynucleotide one or more selected from: (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule ssDNA), (e) a single-stranded DNA molecule that self-hybridizes to form a double-stranded DNA molecule, (f) a single-stranded DNA molecule comprising a modified Pol III gene that is transcribed to an RNA molecule, (g) a double-stranded DNA molecule (dsDNA), (h) a double-stranded DNA molecule comprising a modified Pol III gene that is transcribed to an RNA molecule, and (i) a double-stranded, hybridized RNA/DNA molecule, or combinations thereof. In such embodiments where the polynucleotide is expressed by transient expression the first polynucleotide can consist of naturally occurring nucleotides, such as those which occur in DNA and RNA. In such embodiments where the polynucleotide is expressed by transient expression the first polynucleotide can be chemically modified or comprises chemically modified nucleotides. The first polynucleotide is provided by suitable means known to one in the art. The first polynucleotide can be provided as an RNA or DNA fragment. Alternatively, the first polynucleotide can be provided in more complex constructs, e.g., as part of a recombinant expression construct, or included in a recombinant vector, for example in a recombinant plant virus vector or in a recombinant baculovirus vector; such recombinant expression constructs or vectors can be designed to include additional elements, such as expression cassettes for expressing a gene of interest (e.g., a fungicidal protein).

In some embodiments the polynucleotide expressed in the plant is an RNA molecule and can be relatively short, such as single- or double-stranded RNAs of between about 18 to about 300 or between about 50 to about 500 nucleotides (for single-stranded RNAs) or between about 18 to about 300 or between about 50 to about 500 base-pairs (for double-stranded RNAs). Alternatively, the polynucleotide can be provided in more complex constructs, e.g., as part of a recombinant expression construct, or included in a recombinant vector, for example in a recombinant plant virus vector or in a recombinant baculovirus vector. In some embodiments such recombinant expression constructs or vectors are designed to include additional elements, such as expression cassettes for expressing a gene of interest (e.g., a fungicidal protein).

The polynucleotide expressed in the plant has at least one segment of 18 or more contiguous nucleotides with a sequence of about 95% to about 100% identity with a fragment of equivalent length of a DNA having a sequence selected from the Target Gene Sequences Group or the DNA complement thereof. In an embodiment the polynucleotide expressed in the plant comprises at least one segment of 18 or more contiguous nucleotides that are essentially identical or complementary to a fragment of equivalent length of a DNA having a sequence selected from the group consisting of the Target Gene Sequences Group. In some embodiments, the contiguous nucleotides have a sequence of about 95%, about 96%, about 97%, about 98%, about 99%, or about 100% identity with a fragment of a DNA having a sequence selected from the Target Gene Sequences Group or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the polynucleotide expressed in the plant has an overall sequence of about 95%, about 96%, about 97%, about 98%, about 99%, or about 100% identity with a fragment of a DNA having a sequence selected from the Target Gene Sequences Group or the DNA complement thereof.

The polynucleotide expressed in the plant is generally designed to suppress one or more genes ("target genes"). Such target genes can include coding or non-coding sequence or both. In specific embodiments, the polynucleotide expressed in the plant is designed to suppress one or more target genes, where each target gene has a DNA sequence selected from the group consisting of the Target Gene Sequences Group. In various embodiments, the polynucleotide expressed in the plant is designed to suppress one or more genes, where each gene has a sequence selected from the group consisting of the Target Gene Sequences Group and can be designed to suppress multiple genes from this group, or to target different regions of one or more of these genes. In an embodiment, the polynucleotide expressed in the plant comprises multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence and can be sense or anti-sense relative to the target gene. For example, in one embodiment the polynucleotide expressed in the plant can include multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof the segments can be from different regions of the target gene, e.g., the segments can correspond to different exon regions of the target gene, and "spacer" nucleotides which do not correspond to a target gene can optionally be used in between or adjacent to the segments.

The total length of the polynucleotide expressed in the plant can be greater than 18 contiguous nucleotides and can include nucleotides in addition to the contiguous nucleotides having the sequence of about 95% to about 100% identity with a fragment of equivalent length of a DNA having a sequence selected from the Target Gene Sequences Group or the DNA complement thereof. In other words, the total length of the polynucleotide expressed in the plant can be greater than the length of the section or segment of the polynucleotide designed to suppress one or more target genes, where each target gene has a DNA sequence selected from the group consisting of the Target Gene Sequences Group. For example, the polynucleotide expressed in the plant can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the polynucleotide expressed in the plant comprises additional nucleotides that are not specifically related (i.e., having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the polynucleotide expressed in the plant comprises additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the polynucleotide expressed in the plant comprises one such segment, with an additional 5' G or an additional 3' C or both, adjacent to the segment. In another embodiment, the polynucleotide expressed in the plant is a double-stranded RNA comprising additional nucleotides to form an overhang, for example, a dsRNA comprising 2 deoxyribonucleotides to form a 3' overhang. Thus, in various embodiments, the nucleotide sequence of the entire polynucleotide expressed in the plant is not 100% identical or complementary to a fragment of contiguous nucleotides in the DNA or target gene having a sequence selected from the group consisting of the Target Gene Sequences Group. For example, in some embodiments the polynucleotide expressed in the plant comprises at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In a related aspect, this invention is directed to the plant having improved resistance to *E. necator* infection, provided by expressing in the plant at least one polynucleotide comprising at least one segment of 18 or more contiguous nucleotides that are essentially identical or complementary to a fragment of equivalent length of a DNA having a sequence selected from the group consisting of the Target Gene Sequences Group, whereby the resulting plant has improved resistance to *E. necator* infection when compared to a control plant in which the polynucleotide is not expressed. In a related aspect, this invention is directed to the plant having improved resistance to *E. necator* infection, provided by expressing in the plant at least one polynucleotide comprising at least one segment of 18 or more contiguous nucleotides with a sequence of about 95% to about 100% identity with a fragment of equivalent length of a DNA having a sequence selected from the Target Gene Sequences Group or the DNA complement thereof, whereby the resulting plant has improved resistance to *E. necator* infection when compared to a control plant in which the polynucleotide is not expressed. An embodiment is a grape plant having improved resistance to *E. necator* infection when compared to a control plant, provided by expressing in the plant an RNA having a sequence selected from the Trigger Sequences Group, or the complement thereof. In yet another aspect, this invention is directed to seed or stem cutting (especially transgenic progeny seed or cloned stems) produced by the plant having improved resistance to *E. necator* infection, as provided by this method. Also contemplated is a commodity product produced by the plant having improved resistance to *E. necator* infection, as provided by this method, and a commodity product produced from the transgenic progeny seed of such a plant.

XII. Recombinant DNA Constructs for Controlling *E. necator* Infection

Another aspect of this invention provides a recombinant DNA construct comprising a heterologous promoter operably linked to a DNA element comprising at least one segment of 18 or more contiguous nucleotides with a sequence of about 95% to about 100% identity with a fragment of a DNA having a sequence selected from the Target Gene Sequences Group, or the DNA complement thereof. In some embodiments, the recombinant DNA construct comprises a heterologous promoter operably linked to: (a) DNA comprising a nucleotide sequence that is complementary to at least 18, 19, 20 or 21 contiguous nucleotides of a target gene having a sequence selected from the group consisting of: SEQ ID NOs 1-107 and 492-642. or an RNA transcribed from the target gene; or (b) a DNA comprising 18, 19, 20, or 21 or more contiguous nucleotides having 100% identity to a fragment of equivalent length of a DNA having a sequence selected from the group consisting of: SEQ ID Nos 1-107 and 492-642, or the DNA complement thereof; or (c) DNA encoding at least one silencing element that is complementary to at least 18, 19, 20, or 21 contiguous nucleotides of a target gene or an RNA transcribed from the target gene, wherein the target gene has a sequence selected from the group consisting of: SEQ ID 1-107 and 492-642; or (d) DNA encoding at least one silencing element comprising at least 18, 19, 20 or 21 contiguous nucleotides that are complementary to a portion of a target gene selected from the genes in the Target Gene Sequences Group or an RNA transcribed from the target gene; or (e) DNA encoding a RNA comprising at least 18, 19, 20, or 21 contiguous nucleotides that are complementary to a nucleotide sequence selected from the Trigger Sequences Group, or the complement thereof, or an orthologous nucleotide sequence from *E. necator*, wherein the orthologous nucleotide sequence has at least 95% sequence identity with a nucleotide sequence selected from the Trigger Sequences Group, wherein the percentage sequence identity is calculated over the same length; or (f) DNA encoding a RNA comprising at least one double-stranded RNA region, at least one strand of which comprises at least 18, 19, 20 or 21 contiguous nucleotides that are complementary to a nucleotide sequence selected from the Trigger Sequences Group, or the complement thereof, or an orthologous nucleotide sequence from *E. necator*, wherein the orthologous nucleotide sequence has at least 95% sequence identity with a nucleotide sequence selected from the group consisting of the Trigger Sequences Group, wherein the percentage sequence identity is calculated over the same length; or (g) DNA encoding RNA comprising a nucleotide sequence selected from the Trigger Sequences Group, or the complement thereof. Embodiments include a recombinant DNA construct comprising a heterologous promoter operably linked to a DNA element encoding an RNA having a sequence selected from the group consisting of: SEQ ID NOs 108-214, 643-856, 215-321, 857-1070, 322-428, and 1071-1284 or a combination thereof, or the complement thereof.

Embodiments include a recombinant DNA construct comprising a heterologous promoter operably linked to a DNA encoding a dsRNA with a strand having a sequence selected from the group consisting of the Trigger Sequences Group. The recombinant DNA constructs are useful in providing a plant having improved resistance to *E. necator* infection, e.g., by expressing in a plant a transcript of such a recombinant DNA construct. The recombinant DNA constructs are also useful in the manufacture of polynucleotides useful in making compositions that can be applied to a plant, seed, propagatable plant part, soil or field, or surface in need of protection from *E. necator* infection. Related aspects of the invention include: compositions comprising the recombinant DNA construct; a plant chromosome or a plastid or a recombinant plant virus vector or a recombinant baculovirus vector comprising the recombinant DNA construct; a transgenic *V. vinifera* plant cell having in its genome the recombinant DNA construct, and a transgenic *V. vinifera* plant including such a transgenic *V. vinifera* plant cell, or a fruit, seed, or propagatable part of the transgenic plant; and plants having improved *E. necator* and pest resistance provided by expression of or treatment with the recombinant DNA construct or the RNA encoded therein.

The recombinant DNA construct comprises a heterologous promoter operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. In some embodiments, the segment of 18 or more contiguous nucleotides has a sequence with about 95%, about 96%, about 97%, about 98%, about 99%, or about 100% identity with a fragment of a DNA having a sequence selected from the Target Gene Sequences Group or the DNA complement thereof. In some embodiments the contiguous nucleotides are exactly (100%) identical to a fragment of equivalent length of a DNA having a sequence selected from the Target Gene Sequences Group or the DNA complement thereof. In some embodiments, the DNA has an overall sequence of about 95%, about 96%, about 97%, about 98%, about 99%, or about 100% identity with a DNA having a sequence selected from the Target Gene Sequences Group or the DNA complement thereof.

The recombinant DNA construct therefore comprises a heterologous promoter operably linked to DNA comprising at least one segment of 18 or more contiguous nucleotides designed to suppress expression of a target gene having a sequence selected from the Target Gene Sequences Group or the DNA complement thereof. In some embodiments the DNA comprises at least one segment of 18 or more contiguous nucleotides, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments the segment comprises more than 18 contiguous nucleotides, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the DNA encodes an RNA containing at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof. In particular embodiments, the DNA encodes a double-stranded nucleic acid (e.g., dsRNA) with one strand comprising at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 18, 19, 20, or 21 contiguous, perfectly matched base-pairs which correspond to a fragment of equivalent length of a DNA or target gene having a sequence selected from the Target Gene Sequences Group or the DNA complement thereof. In particular embodiments, each segment contained in the DNA is of a length greater than that which is typical of naturally occurring regulatory small RNAs. In some embodiments, each segment is at least about 30 contiguous nucleotides (or base-pairs) in length. In some embodiments, the total length of the DNA, or the length of each segment contained in the polynucleotide, is less than the total length of the sequence of interest (DNA or target gene having a sequence selected from the group consisting of the Target Gene Sequences Group). In some embodiments, the total length of the DNA is between about 50 to about 500. In some embodiments, the DNA encodes an RNA having a sequence selected from the group consisting of: SEQ ID NOs 108-214, 643-856, 215-321, 857-1070, 322-428, and 1071-1284 or a combination thereof, or the complement thereof.

The recombinant DNA construct comprises a heterologous promoter operably linked to DNA generally designed to suppress one or more genes ("target genes"). Such target genes can include coding or non-coding sequence or both. In specific embodiments, the recombinant DNA construct is designed to suppress one or more target genes, where each target gene has a DNA sequence selected from the group consisting of the Target Gene Sequences Group. In various embodiments, the recombinant DNA construct is designed to suppress one or more genes, where each gene has a sequence selected from the group consisting of the Target Gene Sequences Group and can be designed to suppress multiple genes from this group, or to target different regions of one or more of these genes. In an embodiment, the recombinant DNA construct comprises a heterologous promoter operably linked to multiple sections or segments each of which comprises at least one segment of 21 contiguous nucleotides with a sequence of 100% identity with a fragment of equivalent length of a DNA having a sequence selected from the Target Gene Sequences Group or the DNA complement thereof. In such cases, each section can be identical or different in size or in sequence and can be sense or anti-sense relative to the target gene. For example, in one embodiment the recombinant DNA construct can include a heterologous promoter operably linked to multiple sections in tandem or repetitive arrangements, wherein each section comprises at least one segment of 21 contiguous nucleotides with a sequence of 100% identity with a fragment of equivalent length of a DNA having a sequence selected from the Target Gene Sequences Group or the DNA complement thereof, the segments can be from different regions of the target gene, e.g., the segments can correspond to different exon regions of the target gene, and "spacer" nucleotides which do not correspond to a target gene can optionally be used in between or adjacent to the segments.

The recombinant DNA construct comprises a heterologous promoter operably linked to DNA which can have a total length that is greater than 18 contiguous nucleotides, and can include nucleotides in addition to the segment of at least one segment of 18 or more contiguous nucleotides having the sequence of about 95% to about 100% identity with a fragment of equivalent length of a DNA having a sequence selected from the Target Gene Sequences Group or the DNA complement thereof. In other words, the total length of the DNA can be greater than the length of the segment of the DNA designed to suppress one or more target genes, where each target gene has a DNA sequence selected from the group consisting of the Target Gene Sequences Group. For example, the DNA can have nucleotides flanking the "active" segment of at least one segment of 18 or more contiguous nucleotides that suppresses the target gene, or include "spacer" nucleotides between active segments, or can have additional nucleotides at the 5' end, or at the 3' end, or at both the 5' and 3' ends. In an embodiment, the heterologous promoter is operably linked to DNA comprising additional nucleotides that are not specifically related (having a sequence not complementary or identical to) to the DNA or target gene having a sequence selected from the Target Gene Sequences Group or the DNA complement thereof, e.g., nucleotides that provide stabilizing secondary structure or for convenience in cloning or manufacturing. In an embodiment, the heterologous promoter is operably linked to DNA comprising additional nucleotides located immediately adjacent to one or more segment of 18 or more contiguous nucleotides with a sequence of about 95% to about 100% identity with or complementarity to a fragment of equivalent length of a DNA or target gene having a sequence selected from the group consisting of the Target Gene Sequences Group. In an embodiment, the heterologous promoter is operably linked to DNA comprising one such segment, with an additional 5' G or an additional 3' C or both, adjacent to the segment. In another embodiment, the heterologous promoter is operably linked to DNA encoding a double-stranded RNA comprising additional nucleotides to form an overhang. Thus, in various embodiments, the nucleotide sequence of the entire DNA operably linked to the heterologous promoter is not 100% identical or complementary to a fragment of contiguous nucleotides in the DNA or target gene having a sequence selected from the group consisting of the Target Gene Sequences Group. For example, in some embodiments the heterologous promoter is operably linked to DNA comprising at least two segments each of 21 contiguous nucleotides with a sequence of 100% identity with a fragment of a DNA having a sequence selected from the Target Gene Sequences Group, or the DNA complement thereof, wherein (1) the at least two segments are separated by one or more spacer nucleotides, or (2) the at least two segments are arranged in an order different from that in which the corresponding fragments occur in the DNA having a sequence selected from the Target Gene Sequences Group, or the DNA complement thereof.

In recombinant DNA constructs, the heterologous promoter is operably linked to DNA that encodes a transcript that can be single-stranded (ss) or double-stranded (ds) or a combination of both. Embodiments of the method include those wherein the DNA encodes a transcript comprising sense single-stranded RNA (ssRNA), anti-sense ssRNA, or double-stranded RNA (dsRNA), or a combination of any of these.

The recombinant DNA construct is provided by suitable means known to one in the art. Embodiments include those wherein the recombinant DNA construct is synthesized in vitro, produced by expression in a microorganism or in cell culture (such as plant cells grown in culture), produced by expression in a plant cell, or produced by microbial fermentation.

The heterologous promoter of use in recombinant DNA constructs is selected from the group consisting of a promoter functional in a plant, a promoter functional in a prokaryote, a promoter functional in a fungal cell, and a baculovirus promoter. Non-limiting examples of promoters are described in the section headed "Promoters".

In some embodiments, the recombinant DNA construct comprises a second promoter also operably linked to the DNA. For example, the DNA comprising at least one segment of 18 or more contiguous nucleotides can be flanked by two promoters arranged so that the promoters transcribe in opposite directions and in a convergent manner, yielding opposite-strand transcripts of the DNA that are complementary to and capable of hybridizing with each other to form double-stranded RNA. In one embodiment, the DNA is located between two root-specific promoters, which enable transcription of the DNA in opposite directions, resulting in the formation of dsRNA.

In some embodiments the recombinant DNA construct comprises other DNA elements in addition to the heterologous promoter operably linked to DNA comprising at least one segment of 18 or more contiguous nucleotides with a sequence of about 95% to about 100% identity with a fragment of equivalent length of a DNA having a sequence selected from the Target Gene Sequences Group or the DNA complement thereof. Such DNA elements are known in the art, and include but are not limited to introns, recombinase recognition sites, aptamers or ribozymes, and additional expression cassettes for expressing coding sequences (e.g., to express a transgene such as a fungicidal protein or selectable marker) or non-coding sequences (e.g., to express additional suppression elements). Inclusion of one or more recognition sites for binding and cleavage by a small RNA (e.g., by a miRNA or an siRNA that is expressed only in a particular cell or tissue) allows for more precise expression patterns in a plant, wherein the expression of the recombinant DNA construct is suppressed where the small RNA is expressed.

In some embodiments, the recombinant DNA construct is provided in a recombinant vector. By "recombinant vector" is meant a recombinant polynucleotide molecule that is used to transfer genetic information from one cell to another. Embodiments suitable to this invention include, but are not limited to, recombinant plasmids, recombinant cosmids, artificial chromosomes, and recombinant viral vectors such as recombinant plant virus vectors and recombinant baculovirus vectors. Alternative embodiments include recombinant plasmids, recombinant cosmids, artificial chromosomes, and recombinant viral vectors such as recombinant plant virus vectors and recombinant baculovirus vectors comprising the DNA element without the heterologous promoter.

In some embodiments, the recombinant DNA construct is provided in a plant chromosome or plastid, e.g., in a transgenic plant cell or a transgenic plant. Thus, also encompassed by this invention is a transgenic plant cell having in its genome the recombinant DNA construct, as well as a transgenic plant or partially transgenic plant including such a transgenic plant cell. Partially transgenic plants include, e.g., a non-transgenic scion grafted onto a transgenic rootstock including the transgenic plant cell. Embodiments include a transgenic tomato rootstock including the transgenic plant cell. The plant can be any plant that is subject to infection by *E. necator*. Embodiments include those wherein the plant is an ungerminated plant seed, a plant in a vegetative stage, or a plant in a reproductive stage. In yet another aspect, this invention is directed to seed (especially transgenic progeny seed) produced by the transgenic plant having in its genome a recombinant DNA construct as described herein. Also contemplated is a commodity product produced by such a transgenic plant, and a commodity product produced from the transgenic progeny seed of such a transgenic plant.

The recombinant DNA construct can be provided in a composition for topical application to a surface of a plant or of a plant seed, root, or stem, or for topical application to any substrate needing protection from *E. necator* infection. Likewise, the recombinant DNA construct can be provided in a composition for topical application to *E. necator*, or in a composition for internal absorption (e.g., transfection) by *E. necator*. In various embodiments, such compositions containing the recombinant DNA construct are provided in the form of at least one selected from the group consisting of a solid, liquid (including homogeneous mixtures such as solutions and non-homogeneous mixtures such as suspensions, colloids, micelles, and emulsions), powder, suspension, emulsion, spray, encapsulated or micro-encapsulation formulation, in or on microbeads or other carrier particulates, in a film or coating, or on or within a matrix, or as a leaf, seed, root, or stem treatment. The topical application can be in the form of topical treatment of fruits of *V. vinifera* plants or seeds from fruits of *V. vinifera* plants. Suitable binders, inert carriers, surfactants, and the like can be included in the composition containing the recombinant DNA construct, as is known to one skilled in formulation of pesticides and seed treatments. In some embodiments, the composition for topical application containing the recombinant DNA construct is at least one topically implantable formulation selected from the group consisting of a particulate, pellet, or capsule topically implanted in the plant; in such embodiments the method comprises topically implanting in the plant the topically implantable formulation. In one embodiment the composition for topical application containing the recombinant DNA construct can be absorbed internally (e.g., transfection) by *E. necator*. In some embodiments, the composition containing the recombinant DNA construct further comprises one or more components selected from the group consisting of a carrier agent, a surfactant, incorporated by reference herein), an organosilicone, an organosilicone surfactant, a polynucleotide herbicidal molecule, a non-polynucleotide herbicidal molecule, a non-polynucleotide pesticide, a polynucleotide pesticide, a safener, and a pathogen growth regulator. In one embodiment the composition containing the recombinant DNA construct further comprises a nonionic organosilicone surfactant such as SILWET® brand surfactants, e.g., SILWET L-77® brand surfactant having CAS Number 27306-78-1 and EPA Number: CAL.REG.NO. 5905-50073-AA, currently available from Momentive Performance Materials, Albany, N.Y. BREAK-THRU S 240 brand is a Polyether Modified Polysiloxane (CASRN Proprietary) surfactant, currently available from Goldschmidt Chemical Corporation, Hopewell, VA BREAK-THRU S 279 is an end capped polyether trisiloxane surfactant, which components are listed in the following chemical inventories: EINECS, TSCA, ENCS, AICS, ECL, PICCS CHINA, NDSL. INDUCE brand adjuvant NMFC Item 42652, Class 60, currently available from Helena Chemical Company, Collierville, TN FRANCHISE® with LECI-TECH® brand surfactant having a CA REG No. 34704-50065, currently available from Loveland Products, Inc. Greely, CO One embodiment includes a composition that further comprises BREAK-thru 301.

It is anticipated that the combination of certain recombinant DNA constructs as described herein (e.g., recombinant DNA constructs including the polynucleotide triggers described in the working Examples), whether transgenically expressed or topically applied, with one or more non-polynucleotide pesticidal agents, whether transgenically expressed or topically applied, will result in an enhanced improvement in prevention or control of *E. necator* infection and pest infestation, when compared to the effect obtained with the recombinant DNA constructs alone or the non-polynucleotide pesticidal agent alone. In an embodiment, a recombinant DNA construct for expressing one or more polynucleotides as well as one or more genes encoding a non-polynucleotide pesticidal agent, is found to provide improved resistance to *E. necator* infections and pest infestation in plants expressing the recombinant DNA construct. An embodiment relates to a recombinant DNA construct for expressing an RNA comprising a segment having a sequence selected from the Trigger Sequences Group as well as one or more genes encoding a non-polynucleotide pesticidal agent.

In various embodiments, the composition containing the recombinant DNA construct comprises a microbial cell or is produced in a microorganism. For example, the composition for containing the recombinant DNA construct can include or can be produced in bacteria or yeast cells. In similar embodiments the composition containing the recombinant DNA construct comprises a transgenic plant cell or is produced in a plant cell (for example a plant cell transiently expressing the recombinant DNA construct); such plant cells can be cells in a plant or cells grown in tissue culture or in cell suspension.

XIII. Transgenic Plant Cells

Several embodiments relate to transgenic plant cells expressing a polynucleotide useful in the methods described herein for suppressing expression of a target gene in *E. necator* or for controlling an *E. necator* infection. In one aspect this invention provides a transgenic *V. vinifera* plant cell having in its genome a recombinant DNA encoding RNA comprising at least one segment of 18 or more contiguous nucleotides with a sequence of about 95% to about 100% identity with a fragment of a DNA having a sequence selected from the Target Gene Sequences Group, or the DNA complement thereof. In one aspect this invention provides a transgenic *V. vinifera* plant cell having in its genome a recombinant DNA encoding RNA comprising at least one silencing element essentially identical or essentially complementary to a fragment of a target gene sequence of *E. necator*, wherein the target gene sequence is selected from the Target Gene Sequences Group, or the DNA complement thereof. In one aspect this invention provides a transgenic *V. vinifera* plant cell having in its genome a recombinant DNA encoding RNA that suppresses expression of a target gene in *E. necator* that contacts or absorbs internally the RNA, wherein the RNA comprises at least one silencing element having at least one segment of 18 or more contiguous nucleotides complementary to a fragment of the target gene, and wherein the target gene is selected from the group consisting of the genes in the Target Gene Sequences Group. A specific embodiment is a transgenic grape plant cell having in its genome a recombinant DNA encoding RNA that suppresses expression of a target gene in *E. necator* that contacts or absorbs internally the RNA, wherein the RNA comprises at least one silencing element having at least one segment of 18 or more contiguous nucleotides complementary to a fragment of one or more Target Gene Sequences Group. In one aspect this invention provides a transgenic grape plant cell having in its genome a recombinant DNA encoding an RNA having a sequence selected from the Trigger Sequences Group. Such transgenic grape plant cells are useful in providing a transgenic grape plant having improved resistance to *E. necator* infection when compared to a control plant lacking such plant cells. The transgenic grape plant cell can be an isolated transgenic *V. vinifera* plant cell, or a transgenic *V. vinifera* plant cell grown in culture, or a transgenic cell of any transgenic grape plant that is subject to infection by *E. necator*.

In an embodiment, the recombinant DNA is stably integrated into the transgenic grape plant's genome from where it can be expressed in a cell or cells of the transgenic *V. vinifera* plant. Methods of providing stably transformed plants are provided in the section headed "Making and Using Transgenic Plant Cells and Transgenic Plants".

Several embodiments relate to a transgenic *Vitis vinifera* plant cell having in its genome a recombinant DNA encoding RNA that suppresses expression of a target gene in *E. necator* that contacts or absorbs internally the RNA, wherein the RNA comprises at least one silencing element complementary to the target gene, and wherein the target gene sequence is selected from the Target Gene Sequences Group or the complement thereof. In some embodiments, the silencing element comprises at least one 18 or more contiguous nucleotides with a sequence of about 95% to about 100% complementarity to a fragment of equivalent length of a DNA having a sequence selected from the group consisting of the Target Gene Sequences Group. In some embodiments, the silencing element comprises at least one 18 or more contiguous nucleotides capable of hybridizing in vivo or of hybridizing under physiological conditions (e.g., such as physiological conditions normally found in the cells of *E. necator*) to a fragment of equivalent length of a DNA having a sequence selected from the group consisting of the Target Gene Sequences Group. The contiguous nucleotides number at least 18, e.g., between 18-24, or between 18-28, or between 20-30, or between 20-50, or between 20-100, or between 50-100, or between 50-500, or between 100-250, or between 100-500, or between 200-1000, or between 500-2000, or even greater. In some embodiments, the contiguous nucleotides number more than 18, e.g., 19, 20, 21, 22, 23, 24, 25, 26, 27, 28, 29, 30, or greater than 30, e.g., about 35, about 40, about 45, about 50, about 55, about 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, about 300, about 350, about 400, about 450, about 500, or greater than 500 contiguous nucleotides. In particular embodiments, the silencing element comprises at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof. In particular embodiments, the RNA is a double-stranded nucleic acid (e.g., dsRNA) with one strand comprising at least one segment of at least 18, 19, 20, or 21 contiguous nucleotides with a sequence of 100% identity with a fragment of equivalent length of a DNA or target gene having a sequence selected from the Target Gene Sequences Group or the DNA complement thereof; expressed as base-pairs, such a double-stranded nucleic acid comprises at least one segment of at least 18, 19, 20, or 21 contiguous, perfectly matched base-pairs which correspond to a fragment of equivalent length of a DNA or target gene having a sequence selected from the Target Gene Sequences Group or the DNA complement thereof. In particular embodiments, each silencing element contained in the RNA is of a length greater than that which is typical of naturally occurring regulatory small RNAs. In some embodiments, each segment is at least about 30 contiguous nucleotides (or base-pairs) in length. In particular embodiments, the RNA is between about 50 to about 500 nucleotides in length. In particular embodiments, the RNA has a sequence selected from the Trigger Sequences Group.

In some embodiments, the transgenic grape plant cell is further capable expressing additional heterologous DNA sequences. In particular embodiments, the transgenic grape plant cell has stably integrated in its genome (i) recombinant DNA encoding at least one RNA with a sequence selected from the Trigger Sequences Group and (ii) DNA encoding at least one fungicidal agent.

In a related aspect, this invention is directed to a transgenic grape plant including the transgenic grape plant cell, a commodity product produced from the transgenic grape plant, and transgenic progeny *V. vinifera* plant seed or transgenic propagatable part of the transgenic *V. vinifera* plant. Also contemplated is a commodity product produced by the transgenic grape plant, and a commodity product produced from the transgenic progeny seed of such a transgenic grape plant.

XIV. Methods of Producing Polynucleotides for RNAi

Polynucleotides of the claimed methods and compositions may be produced by any suitable method known in the art. Examples of methods for producing an RNA molecule of the present disclosure include, but are not limited to, in vitro transcription (IVT) (such as transcription using a T7 polymerase or other polymerase), chemical synthesis, expression in an organism (e.g., a plant or in a microorganism), or expression in cell culture (e.g., a plant cell culture), and microbial fermentation. In some embodiments, the RNA described herein is made through any one of the processes for cell-free production of RNA described in U.S. Pat. Nos. 10,858,385 or 10,954,541, both of which are incorporated herein by reference.

XV. Promoters

Promoters of use in the invention are functional in the cell in which the construct is intended to be transcribed. Generally, these promoters are heterologous promoters, as used in recombinant constructs, i.e., they are not in nature found to be operably linked to the other nucleic elements used in the constructs described herein. In various embodiments, the promoter is selected from the group consisting of a constitutive promoter, a spatially specific promoter, a temporally specific promoter, a developmentally specific promoter, and an inducible promoter. In many embodiments the promoter is a promoter functional in a plant, for example, a pol II promoter, a pol III promoter, a pol IV promoter, or a pol V promoter.

Non-constitutive promoters suitable for use with the recombinant DNA constructs of this invention include spatially specific promoters, temporally specific promoters, and inducible promoters. Spatially specific promoters can include organelle-, cell-, tissue-, or organ-specific promoters (e.g., a plastid-specific, a root-specific, a pollen-specific, or a seed-specific promoter for expression in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e.g., water deficit or drought, heat, cold, high or low nutrient or salt levels, high or low light levels, or pest or pathogen infection). MicroRNA promoters are useful, especially those having a temporally specific, spatially specific, or inducible expression pattern; examples of miRNA promoters, as well as methods for identifying miRNA promoters having specific expression patterns, are provided in U.S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters of particular interest include the following examples: an opaline synthase promoter isolated from T-DNA of *Agrobacterium*; a cauliflower mosaic virus (CaMV) 35S promoter; enhanced promoter elements or chimeric promoter elements such as an enhanced CaMV 35S promoter linked to an enhancer element (an intron from heat shock protein 70 of *Zea mays*); root specific promoters such as those disclosed in U.S. Pat. Nos. 5,837,848; 6,437,217 and 6,426,446; a maize L3 oleosin promoter disclosed in U.S. Pat. No. 6,433,252: a promoter for a plant nuclear gene encoding a plastid-localized aldolase disclosed in U.S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include, for example, a rolC or rolA promoter of *Agrobacterium rhizogenes*, a promoter of a *A. tumefaciens* T-DNA gene 5, the rice sucrose synthase RSs1 gene promoter, a *Commelina* yellow mottle badnavirus promoter, a coconut foliar decay virus promoter, a rice tungro baciliform virus promoter, the promoter of a pea glutamine synthase GS3A gene, a invCD111 and invCD141 promoters of a potato invertase genes, a promoter isolated from *Arabidopsis* shown to have phloem-specific expression in tobacco by Kertbundit et al. (1991) *Proc. Natl. Acad. Sci. USA.,* 88:5212-5216, a VAHOX1 promoter region, a pea cell wall invertase gene promoter, an acid invertase gene promoter from carrot, a promoter of a sulfate transporter gene Sultr1, a promoter of a plant sucrose synthase gene, and a promoter of a plant sucrose transporter gene.

Promoters suitable for use with a recombinant DNA construct or polynucleotide of this invention may include polymerase II ("pol II") promoters and polymerase III ("pol III") promoters. RNA polymerase II transcribes structural or catalytic RNAs that are usually shorter than 400 nucleotides in length, and recognizes a simple run of T residues as a termination signal; it has been used to transcribe siRNA duplexes (see, e.g., Lu et al. (2004) *Nucleic Acids Res.,* 32:e171). Pol II promoters are therefore in certain embodiments where a short RNA transcript is to be produced from a recombinant DNA construct of this invention. In one embodiment, the recombinant DNA construct comprises a pol II promoter to express an RNA transcript flanked by self-cleaving ribozyme sequences (e.g., self-cleaving hammerhead ribozymes), resulting in a processed RNA, such as a single-stranded RNA that binds to the transcript of the *E. necator* target gene, with defined 5' and 3' ends, free of potentially interfering flanking sequences. An alternative approach uses pol III promoters to generate transcripts with relatively defined 5' and 3' ends, i.e., to transcribe an RNA with minimal 5' and 3' flanking sequences. In some embodiments, Pol III promoters (e.g., U6 or H1 promoters) are for adding a short AT-rich transcription termination site that results in 2 base-pair overhangs (UU) in the transcribed RNA: this is useful, e.g., for expression of siRNA-type constructs. Use of pol III promoters for driving expression of siRNA constructs has been reported; see van de Wetering et al. (2003) *EMBO Rep.,* 4: 609-615, and Tuschl (2002) *Nature Biotechnol.,* 20: 446-448. Baculovirus promoters such as baculovirus polyhedrin and p10 promoters are known in the art and commercially available; see, e.g., Invitrogen's "Guide to Baculovirus Expression Vector Systems (BEVS) and Insect Cell Culture Techniques", 2002 (Life Technologies, Carlsbad, Calif.) and F. J. Haines et al. "Baculovirus Expression Vectors", undated (Oxford Expression Technologies, Oxford, UK).

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer (see "Aptamers", below) and a regulatory region (which can be cis-acting). See, for example, Isaacs et al. (2004) Nat. Biotechnol., 22:841-847, Bayer and Smolke (2005) *Nature Biotechnol.,* 23:337-343, Mandal and Breaker (2004) *Nature Rev. Mol. Cell Biol.,* 5:451-463, Davidson and Ellington (2005) *Trends Biotechnol.,* 23:109-112, Winkler et al. (2002) *Nature,* 419:952-956, Sudarsan et al. (2003) *RNA,* 9:644-647, and Mandal and Breaker (2004) *Nature Struct. Mol. Biol.,* 11:29-35. Such "riboregulators" could be selected or designed for specific spatial or temporal specificity, for example, to regulate translation of DNA that encodes a silencing element for suppressing a *E. necator* target gene only in the presence (or absence) of a given concentration of the appropriate ligand. One example is a riboregulator that is responsive to an endogenous ligand (e.g., jasmonic acid or salicylic acid) produced by the plant when under stress (e.g., abiotic stress such as water, temperature, or nutrient stress, or biotic stress such as attach by pests or pathogens); under stress, the level of endogenous ligand increases to a level sufficient for the riboregulator to begin transcription of the DNA that encodes a silencing element for suppressing a *E. necator* target gene.

XVI. Recombinase Sites

In some embodiments, the recombinant DNA construct or polynucleotide of this invention comprises DNA encoding one or more site-specific recombinase recognition sites. In one embodiment, the recombinant DNA construct comprises at least a pair of loxP sites, wherein site-specific recombination of DNA between the loxP sites is mediated by a Cre recombinase. The position and relative orientation of the loxP sites is selected to achieve the desired recombination; for example, when the loxP sites are in the same orientation, the DNA between the loxP sites is excised in circular form. In another embodiment, the recombinant DNA construct comprises DNA encoding one loxP site; in the presence of Cre recombinase and another DNA with a loxP site, the two DNAs are recombined.

XVII. Transgene Transcription Units

In some embodiments, the recombinant DNA construct or polynucleotide of this invention comprises a transgene transcription unit. A transgene transcription unit comprises DNA sequence encoding a gene of interest, e.g., a natural protein or a heterologous protein. A gene of interest can be any coding or non-coding sequence from any species (including, but not limited to, non-eukaryotes such as bacteria, and viruses fungi, protists, plants, invertebrates, and vertebrates). The transgene transcription unit can further include 5' or 3' sequence or both as required for transcription of the transgene.

XVIII. Introns

In some embodiments, the recombinant DNA construct or polynucleotide of this invention comprises DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus of eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e.g., the tobacco mosaic virus 5' leader sequence or "omega" leader described as enhancing expression in plant genes by Gallie and Walbot (1992) *Nucleic Acids Res.,* 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

XIX. Ribozymes

In some embodiments, the recombinant DNA construct or polynucleotide of this invention comprises DNA encoding one or more ribozymes. Ribozymes of particular interest include a self-cleaving ribozyme, a hammerhead ribozyme, or a hairpin ribozyme. In one embodiment, the recombinant DNA construct comprises DNA encoding one or more ribozymes that serve to cleave the transcribed RNA to provide defined segments of RNA, such as silencing elements for suppressing a *E. necator* target gene.

XX. Gene Suppression Elements

In some embodiments, the recombinant DNA construct or polynucleotide of this invention comprises DNA encoding additional gene suppression element for suppressing a target gene other than an *E. necator* target gene. The target gene to be suppressed can include coding or non-coding sequence or both.

Suitable gene suppression elements are described in detail in U.S. Patent Application Publication 2006/0200878, which disclosure is specifically incorporated herein by reference, and include one or more of:

(a) DNA that comprises at least one anti-sense DNA segment that is anti-sense to at least one segment of the gene to be suppressed;

(b) DNA that comprises multiple copies of at least one anti-sense DNA segment that is anti-sense to at least one segment of the gene to be suppressed;

(c) DNA that comprises at least one sense DNA segment that is at least one segment of the gene to be suppressed;

(d) DNA that comprises multiple copies of at least one sense DNA segment that is at least one segment of the gene to be suppressed;

(e) DNA that transcribes to RNA for suppressing the gene to be suppressed by forming double-stranded RNA and comprises at least one anti-sense DNA segment that is anti-sense to at least one segment of the gene to be suppressed and at least one sense DNA segment that is at least one segment of the gene to be suppressed;

(f) DNA that transcribes to RNA for suppressing the gene to be suppressed by forming a single double-stranded RNA and comprises multiple serial anti-sense DNA segments that are anti-sense to at least one segment of the gene to be suppressed and multiple serial sense DNA segments that are at least one segment of the gene to be suppressed;

(g) DNA that transcribes to RNA for suppressing the gene to be suppressed by forming multiple double strands of RNA and comprises multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;

(h) DNA that comprises nucleotides derived from a plant miRNA;

(i) DNA that comprises nucleotides of a siRNA;

(j) DNA that transcribes to an RNA aptamer capable of binding to a ligand; and (k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron, is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

XXI. Transcriptional Regulatory Elements

In some embodiments, the recombinant DNA construct or polynucleotide of this invention comprises DNA encoding a transcriptional regulatory element. Transcriptional regulatory elements include elements that regulate the expression level of the recombinant DNA construct of this invention (relative to its expression in the absence of such regulatory elements). Examples of suitable transcriptional regulatory elements include riboswitches (cis- or trans-acting), transcript stabilizing sequences, transcription initiation sites, transcription elongation sequences, transcription stop elements and miRNA recognition sites, as described in detail in U.S. Patent Application Publication 2006/0200878, specifically incorporated herein by reference.

XXII. Making and Using Transgenic Plant Cells and Transgenic Plants

Transformation of a plant can include any of several well-known methods and compositions. Suitable methods for plant transformation include virtually any method by which DNA can be introduced into a cell. One method of plant transformation is microprojectile bombardment, for example, as illustrated in U.S. Pat. No. 5,015,580 (soybean), U.S. Pat. No. 5,538,880 (maize), U.S. Pat. No. 5,550,318 (maize), U.S. Pat. No. 5,914,451 (soybean), U.S. Pat. No. 6,153,812 (wheat), U.S. Pat. No. 6,160,208 (maize), U.S. Pat. No. 6,288,312 (rice), U.S. Pat. No. 6,365,807 (rice), and U.S. Pat. No. 6,399,861 (maize), and U.S. Pat. No. 6,403,865 (maize), all of which are incorporated by reference for enabling the production of transgenic plants.

Another useful method of plant transformation is *Agrobacterium*-mediated by means of *Agrobacterium* containing a binary Ti plasmid system, wherein the *Agrobacterium* carries a first Ti plasmid (often disarmed) and a second, chimeric plasmid containing at least one T-DNA border of a wild-type Ti plasmid, a promoter functional in the transformed plant cell and operably linked to a polynucleotide or recombinant DNA construct of this invention. See, for example, the binary system described in U.S. Pat. No. 5,159,135, incorporated by reference. Also see De Framond (1983) *Biotechnology*, 1:262-269; and Hoekema et al., (1983) *Nature*, 303:179. In such a binary system, the smaller plasmid, containing the T-DNA border or borders, can be conveniently constructed and manipulated in a suitable alternative host, such as *E. coli*, and then transferred into *Agrobacterium*.

Detailed procedures for *Agrobacterium*-mediated transformation of plants, especially crop plants, include procedures disclosed in U.S. Pat. Nos. 5,004,863, 5,159,135, and 5,518,908 (cotton); U.S. Pat. Nos. 5,416,011, 5,569,834, 5,824,877 and 6,384,301 (soybean); U.S. Pat. Nos. 5,591,616 and 5,981,840 (maize); 5,463,174 (brassicas including canola), 7,026,528 (wheat), and 6,329,571 (rice), and in U.S. Patent Application Publications 2004/0244075 (maize) and 2001/0042257 A1 (sugar beet), all of which are specifically incorporated by reference for enabling the production of transgenic plants. U. S. Patent Application Publication 2011/0296555 discloses in Example 5 the transformation vectors (including the vector sequences) and detailed protocols for transforming maize, soybean, canola, cotton, and sugarcane) and is specifically incorporated by reference for enabling the production of transgenic plants. Similar methods have been reported for many plant species, both dicots and monocots, including, among others, peanut (Cheng et al. (1996) Plant Cell Rep., 15: 653); asparagus (Bytebier et al. (1987) Proc. Natl. Acad. Sci. U.S.A., 84:5345); barley (Wan and Lemaux (1994) Plant Physiol., 104:37); rice (Toriyama et al. (1988) Bio/Technology, 6:10; Zhang et al. (1988) Plant Cell Rep., 7:379); wheat (Vasil et al. (1992) Bio/Technology, 10:667; Becker et al. (1994) Plant J., 5:299), alfalfa (Masoud et al. (1996) Transgen. Res., 5:313); and tomato (Sun et al. (2006) Plant Cell Physiol., 47:426-431). See also a description of vectors, transformation methods, and production of transformed *Arabidopsis thaliana* plants where transcription factors are constitutively expressed by a CaMV35S promoter, in U. S. Patent Application Publication 2003/0167537 A1, incorporated by reference. Transformation methods specifically useful for *V. vinifera* plants are well known in the art. See, for example, publicly described transformation methods for tomato (Sharma et al. (2009), J. Biosci., 34:423-433), eggplant (Arpaia et al. (1997) Theor. Appl. Genet., 95:329-334), potato (Bannerjee et al. (2006) Plant Sci., 170:732-738; Chakravarty et al. (2007) Amer. J. Potato Res., 84:301-311; S. Millam "*Agrobacterium*-mediated transformation of potato." Chapter 19 (pp. 257-270), "Transgenic Crops of the World: Essential Protocols", Ian S. Curtis (editor), Springer, 2004)), and peppers (Li et al. (2003) Plant Cell Reports, 21: 785-788). Stably transgenic potato, tomato, and eggplant have been commercially introduced in various regions; see, e. g., K. Redenbaugh et al. "Safety Assessment of Genetically Engineered Fruits and Vegetables: A Case Study of the FLAVR SAVR Tomato", CRC Press, Boca Raton, 1992, and the extensive publicly available documentation of commercial genetically modified crops in the GM Crop Database; see: CERA. (2012). GM Crop Database. Center for Environmental Risk Assessment (CERA), ILSI Research Foundation, Washington D.C., available electronically at cera-gmc.org/?action=gm_crop_database. Various methods of transformation of other plant species are well known in the art, see, for example, the encyclopedic reference, "Compendium of Transgenic Crop Plants", edited by Chittaranjan Kole and Timothy C. Hall, Blackwell Publishing Ltd., 2008; ISBN 978-1-405-16924-0 (available electronically at mrw.interscience.wiley.com/emrw/9781405181099/hpt/toc), which describes transformation procedures for cereals and forage grasses (rice, maize, wheat, barley, oat, sorghum, pearl millet, finger millet, cool-season forage grasses, and bahiagrass), oilseed crops (soybean, oilseed brassicas, sunflower, peanut, flax, sesame, and safflower), legume grains and forages (common bean, cowpea, pea, *faba* bean, lentil, tepary bean, Asiatic beans, pigeonpea, vetch, chickpea, lupin, alfalfa, and clovers), temperate fruits and nuts (apple, pear, peach, plums, berry crops, cherries, grapes, olive, almond, and Persian walnut), tropical and subtropical fruits and nuts (citrus, grapefruit, banana and plantain, pineapple, *papaya*, mango, avocado, kiwifruit, passionfruit, and persimmon), vegetable crops (tomato, eggplant, peppers, vegetable brassicas, radish, carrot, cucurbits, alliums, asparagus, and leafy vegetables), sugar, tuber, and fiber crops (sugarcane, sugar beet, *stevia*, potato, sweet potato, cassava, and cotton), plantation crops, ornamentals, and turf grasses (tobacco, coffee, cocoa, tea, rubber tree, medicinal plants, ornamentals, and turf grasses), and forest tree species.

Transformation methods to provide transgenic plant cells and transgenic plants containing stably integrated recombinant DNA are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos or parts of embryos, and gametic cells such as microspores, pollen, sperm, and egg cells. Any cell from which a fertile plant can be regenerated is contemplated as a useful recipient cell for practice of this invention. Callus can be initiated from various tissue sources, including, but not limited to, immature embryos or parts of embryos, seedling apical meristems, microspores, and the like. Those cells which are capable of proliferating as callus can serve as recipient cells for genetic transformation. Practical transformation methods and materials for making transgenic plants of this invention (e.g., various media and recipient target cells, transformation of immature embryos, and subsequent regeneration of fertile transgenic plants) are disclosed, for example, in U.S. Pat. Nos. 6,194,636 and 6,232,526 and U.S. Patent Application Publication 2004/0216189, which are specifically incorporated by reference.

In general transformation practice, DNA is introduced into only a small percentage of target cells in any one transformation experiment. Marker genes are generally used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the antibiotics or herbicides to which a plant cell is resistant can be a useful agent for selection. Potentially transformed cells are exposed to the selective agent corresponding to the marker. In the population of surviving cells will be those cells where, generally, the resistance-conferring gene (selective marker) is integrated and expressed at sufficient levels to permit cell survival in the presence of the selective agent. Cells can be tested further to confirm stable integration of the recombinant DNA. Commonly used selective marker genes include those conferring resistance to antibiotics such as kanamycin or paromomycin (nptII), hygromycin B (aph IV) and gentamycin (aac3 and aacC4) or resistance to herbicides such as glufosinate (bar or pat) and glyphosate (EPSPS). Examples of useful selective marker genes and selection agents are illustrated in U.S. Pat. Nos. 5,550,318, 5,633,435, 5,780,708, and 6,118,047, all of which are specifically incorporated by reference. Screenable markers or reporters, such as markers that provide an ability to visually identify transformants can also be employed. Examples of useful screenable markers include, for example, a gene expressing a protein that produces a detectable color by acting on a chromogenic substrate (e.g., beta glucuronidase (GUS) (uidA) or luciferase (luc) or that itself is detectable, such as green fluorescent protein (GFP) (gfp) or an immunogenic molecule. Those of skill in the art will recognize that many other useful markers or reporters are available for use.

Detecting or measuring transcription of a recombinant DNA construct in a transgenic plant cell can be achieved by any suitable method, including protein detection methods (e.g., western blots, ELISAs, and other immunochemical methods), measurements of enzymatic activity, or nucleic acid detection methods (e.g., Southern blots, northern blots, PCR, RT-PCR, fluorescent in situ hybridization).

Other suitable methods for detecting or measuring transcription in a plant cell of a recombinant polynucleotide of this invention targeting E. necator target gene include measurement of any other trait that is a direct or proxy indication of the level of expression of the target gene in E. necator, relative to the level of expression observed in the absence of the recombinant polynucleotide, e.g., growth rates, mortality rates, or reproductive or recruitment rates of E. necator, or measurements of injury (e.g., root injury) or yield loss in a plant or field of plants infected by E. necator. In general, suitable methods for detecting or measuring transcription in a plant cell of a recombinant polynucleotide of interest include, e.g., gross or microscopic morphological traits, growth rates, yield, reproductive or recruitment rates, resistance to pests or pathogens, or resistance to biotic or abiotic stress (e.g., water deficit stress, salt stress, nutrient stress, heat or cold stress). Such methods can use direct measurements of a phenotypic trait or proxy assays (e.g., in plants, these assays include plant part assays such as leaf or root assays to determine tolerance of abiotic stress). Such methods include direct measurements of resistance to E. necator (e.g., damage to plant tissues) or proxy assays (e.g., plant yield assays, or bioassays).

The recombinant DNA constructs of this invention can be stacked with other recombinant DNA for imparting additional traits (e.g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

Seeds of fertile transgenic plants can be harvested and used to grow progeny generations, including hybrid generations, of transgenic plants of this invention that include the recombinant DNA construct in their genome. Thus, in addition to direct transformation of a plant with a recombinant DNA construct of this invention, transgenic plants of this invention can be prepared by crossing a first plant having the recombinant DNA with a second plant lacking the construct. For example, the recombinant DNA can be introduced into a plant line that is amenable to transformation to produce a transgenic plant, which can be crossed with a second plant line to introgress the recombinant DNA into the resulting progeny. A transgenic plant of this invention can be crossed with a plant line having other recombinant DNA that confers one or more additional trait(s) (such as, but not limited to, herbicide resistance, pest or disease resistance, environmental stress resistance, modified nutrient content, and yield improvement) to produce progeny plants having recombinant DNA that confers both the desired target sequence expression behavior and the additional trait(s).

In such breeding for combining traits the transgenic plant donating the additional trait can be a male line (pollinator) and the transgenic plant carrying the base traits can be the female line. The progeny of this cross segregate such that some of the plant will carry the DNA for both parental traits and some will carry DNA for one parental trait; such plants can be identified by markers associated with parental recombinant DNA Progeny plants carrying DNA for both parental traits can be crossed back into the female parent line multiple times, e.g., usually 6 to 8 generations, to produce a homozygous progeny plant with substantially the same genotype as one original transgenic parental line as well as the recombinant DNA of the other transgenic parental line.

Yet another aspect of this invention is a transgenic plant grown from the transgenic seed of this invention. This invention contemplates transgenic plants grown directly from transgenic seed containing the recombinant DNA as well as progeny generations of plants, including inbred or hybrid plant lines, made by crossing a transgenic plant grown directly from transgenic seed to a second plant not grown from the same transgenic seed. Crossing can include, for example, the following steps:

(a) plant seeds or stem cuttings of the first parent plant (e.g., non-transgenic or a transgenic) and a second parent plant that is transgenic according to the invention;
(b) grow the seeds or stem cuttings of the first and second parent plants into plants that bear flowers;
(c) pollinate a flower from the first parent with pollen from the second parent; and
(d) harvest seeds produced on the parent plant bearing the fertilized flower.

It is often desirable to introgress recombinant DNA into elite varieties, e.g., by backcrossing, to transfer a specific desirable trait from one source to an inbred or other plant that lacks that trait. This can be accomplished, for example, by first crossing a superior inbred ("A") (recurrent parent) to a donor inbred ("B") (non-recurrent parent), which carries the appropriate gene(s) for the trait in question, for example, a construct prepared in accordance with the current invention. The progeny of this cross are first selected in the resultant progeny for the desired trait to be transferred from the non-recurrent parent "B", and then the selected progeny is mated back to the superior recurrent parent "A". After five or more backcross generations with selection for the desired trait, the progeny can be essentially hemizygous for loci controlling the characteristic being transferred but are like the superior parent for most or almost all other genes. The last backcross generation would be selfed to give progeny which are pure breeding for the gene(s) being transferred, e.g., one or more transformation events.

Through a series of breeding manipulations, a selected DNA construct can be moved from one line into an entirely different line without the need for further recombinant manipulation. One can thus produce inbred plants which are true breeding for one or more DNA constructs. By crossing different inbred plants, one can produce a large number of different hybrids with different combinations of DNA constructs. In this way, plants can be produced which have the desirable agronomic properties frequently associated with hybrids ("hybrid vigor"), as well as the desirable characteristics imparted by one or more DNA constructs.

In certain transgenic plant cells and transgenic plants of this invention, it is sometimes desirable to concurrently express a gene of interest while also modulating expression of a E. necator target gene. Thus, in some embodiments, the transgenic plant contains recombinant DNA further comprising a gene expression element for expressing at least one gene of interest, and transcription of the recombinant DNA construct of this invention is affected with concurrent transcription of the gene expression element.

This invention also provides commodity products produced from a transgenic plant cell, plant, or seed of this invention, including, but not limited to, harvested leaves, roots, shoots, stems, fruits, seeds, or other parts of a plant, oils, extracts, fermentation or digestion products, or any food or non-food product including such commodity products produced from a transgenic plant cell, plant, or seed of this invention. The detection of one or more of nucleic acid sequences of the recombinant DNA constructs of this invention in one or more commodity or commodity products contemplated herein is de facto evidence that the commodity or commodity product contains or is derived from a transgenic plant cell, plant, or seed of this invention.

Generally, a the genome of a transgenic plant harboring a recombinant DNA construct or a portion thereof of this invention exhibits increased resistance to *E. necator* infection. In various embodiments, for example, where the transgenic plant expresses a recombinant DNA construct of this invention that is stacked with other recombinant DNAs for imparting additional traits, the transgenic plant has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the transgenic plant is characterized by: improved tolerance of abiotic stress (e.g., tolerance of water deficit or drought, heat, cold, non-optimal nutrient or salt levels, non-optimal light levels) or of biotic stress (e.g., crowding, allelopathy, or wounding); by a modified primary metabolite (e.g., fatty acid, oil, amino acid, protein, sugar, or carbohydrate) composition; a modified secondary metabolite (e.g., alkaloids, terpenoids, polyketides, non-ribosomal peptides, and secondary metabolites of mixed biosynthetic origin) composition; a modified trace element (e.g., iron, zinc), carotenoid (e.g., beta-carotene, lycopene, lutein, zeaxanthin, or other carotenoids and xanthophylls), or vitamin (e.g., tocopherols) composition; improved yield (e.g., improved yield under non-stress conditions or improved yield under biotic or abiotic stress); improved ability to use nitrogen, phosphate, or other nutrients; modified agronomic characteristics (e.g., delayed ripening; delayed senescence; earlier or later maturity; improved shade tolerance; improved resistance to root or stalk lodging; improved resistance to "green snap" of stems; modified photoperiod response); modified growth or reproductive characteristics (e.g., intentional dwarfing; intentional male sterility, useful, e.g., in improved hybridization procedures; improved vegetative growth rate; improved germination; improved male or female fertility); improved harvest, storage, or processing quality (e.g., improved resistance to pests during storage, improved resistance to breakage, improved appeal to consumers); or any combination of these traits.

In another embodiment, transgenic seed, or seed produced by the transgenic plant, has modified primary metabolite (e.g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

Generally, screening a population of transgenic plants each regenerated from a transgenic plant cell is performed to identify transgenic plant cells that develop into transgenic plants having the desired trait. The transgenic plants are assayed to detect an enhanced trait, e.g., enhanced water use efficiency, enhanced cold tolerance, increased yield, enhanced nitrogen use efficiency, enhanced seed protein, and enhanced seed oil. Screening methods include direct screening for the trait in a greenhouse or field trial or screening for a surrogate trait. Such analyses are directed to detecting changes in the chemical composition, biomass, physiological properties, or morphology of the plant. Changes in chemical compositions can be detected by analysis of the seed composition and content of protein, free amino acids, oil, free fatty acids, starch, tocopherols, or other nutrients. Changes in growth or biomass characteristics are detected by measuring plant height, stem diameter, internode length, root and shoot dry weights. Changes in physiological properties are identified by evaluating responses to stress conditions, e.g., assays under imposed stress conditions such as water deficit, nitrogen or phosphate deficiency, cold or hot growing conditions, pathogen or insect attack, light deficiency, or increased plant density. Other selection properties include days to flowering, days to pollen shed, days to fruit maturation, fruit quality or amount produced, leaf extension rate, chlorophyll content, leaf temperature, stand, seedling vigor, internode length, plant height, leaf number, leaf area, tillering, brace roots, staying green, stalk lodging, root lodging, plant health, fertility, green snap, and pest resistance. In addition, phenotypic characteristics of harvested fruit, or seeds, can be evaluated; for example, in grape plants this can include the total number or weight of fruit harvested or the color, acidity, sugar content, or flavor of such fruit.

The following Examples are presented for the purposes of illustration and should not be construed as limitations.

EXAMPLES

Summary

The present Examples aims to highlight the development of exogenous application of dsRNA to control *E. necator* on grapevine leaves.

Introduction

RNA interference (RNAi) is a naturally occurring cellular defense system mediated by double-stranded RNA (dsRNA). The first component of the RNAi machinery to respond to the dsRNA is the RNase III endonuclease Dicer-2, which cleaves the dsRNA into short (typically 19-21 nucleotides long) interfering RNAs (siRNAs). Dicer-2, with the help of dsRNA-binding proteins facilitates the transfer of the siRNA to the RNA-induced silencing complex. RNAi promotes genetic silencing affecting the translation of the host genetic material. Since RNAi is a sequence-specific method of suppressing a targeted gene's expression, and because each species is defined by the uniqueness of its gene's sequences, RNAi can be designed in a species-specific manner. By targeting genes essential for pathogen growth or development, RNAi can be used selectively to control *E. necator* without adversely affecting non-target species.

Example 1

Leaf Disc Assay Demonstrating Activity of ES43
Materials
Inoculum

*E. necator* isolates LNYM, NY90 and G14 were used for inoculations. Conidial suspensions were prepared and maintained on surface-sterilized detached leaves of *Vitis vinifera* Chardonnay cultivar according to Cadle-Davidson et al. 2016, Horticulture Research, 3, and Lance Cadle-Davidson et al., 2016. Lessons from a phenotyping center revealed by the genome-guided mapping of powdery mildew resistance loci. Phytopathology 106:1159-1169. Briefly, conidial suspensions were obtained by shaking out seven leaves with visible 7- to 10-day-old powdery mildew colonies in 20 ml of 0.001% Tween 20 in sterile water. The inoculum concentration was determined using a hemocytometer and adjusted to a concentration of $7\times10^4$ conidia/ml.

Plant Tissue

*V. vinifera* Chardonnay cultivar growing under greenhouse conditions in Geneva (NY) was used to test endogenous application of naked dsRNA. Leaf discs (1 cm$^2$) from young leaves were used to test the ability of exogenously applied, gene specific dsRNAs to decrease powdery mildew disease severity. Leaves were collected, sterilized, and stored at 4° C. in a plastic box until further analysis. The surface of leaves was sterilized by submersing the leaves into a 10% bleach solution for 2 min with constant agitation and then washed three times in sterile distilled water for at least 1 min. After sterilization, excess moisture was removed by placing the leaves on a sterile paper towel inside of a laminar flow hood.

Methods
dsRNA Treatments and Inoculation dsRNA treatments were sprayed ~6" away from the leaf using an atomizer to get a fine mist of small droplets covering the desired area. Ten leaf disks (subsamples) obtained from four leaves of a similar physiological age were used for each treatment combination.

Treatments were applied on leaf discs (subsamples) and collected. Subsamples were collected using a 1-cm corkborer and randomly placed on an acrylic tray (351 samples) containing 1% water agar. After 24 hours post-dsRNA-treatment leaf discs were inoculated by spraying them with an aerosol of the conidial suspension until the leaf surface bore visible droplets (approximately 5- to 10-ul in volume). Droplets were allowed to dry, and the trays were immediately covered to maintain high humidity, at 23° C. with a 12-hr photoperiod with 45 mmol*m2*s−1 of PAR during 3- to 12-days post inoculation (dpi) when samples were collected for imaging analyses.

Automated Phenotyping System (APS)

Leaf disc samples were imaged using a high-resolution DSLR camera and a long-working distance macrofocusing lens (800 sub-images per disk). Images were taken and stacked into a single fully focused image through a focus-stacking algorithm (see Bierman et al. 2019). Disease severity (%) was then calculated using a neural network developed at the USDA (Dr. Lance Cadle-Davidson), based on the presence or absence of *E. necator* hyphae in each subimage. Disease severity was assessed comparing dsRNA-treated samples with a non-target dsRNA sequence (GS4 or GS145) and untreated control (UTC).

Tables 1A-B. Selection of dsRNA sequences selected for investigation into ability to control *E. necator* on grapevine leaves. Targeted genes are involved in, for example, *Erysiphe* cell division, primary metabolism, transport, signaling pathways, transcription factors, fungal elicitors and effectors involved in pathogenesis.

TABLE 1A

| Universal_ID | Starting Sequence ID | Gene Target | Target SEQ. ID NO. | Trig SEQ ID NO | RNA Trigger SEQ ID NO | RNA Reverse Complement Trigger SEQ ID NO |
|---|---|---|---|---|---|---|
| ES43 | CPY51_consensus | Cytochrome P450 | 1 | 108 | 215 | 322 |
| ES45 | EnCSEP023_1_grape_c18550_consensus | Hypothetical effector | 2 | 109 | 216 | 323 |
| ES46 | EnCSEP043_1_grape_c4920_consensus | Hypothetical effector | 3 | 110 | 217 | 324 |
| ES48 | EpCSEP001_grape_c12308grape_c12308 | Hypothetical effector | 4 | 111 | 218 | 325 |
| ES49 | EpCSEP009_grape_c7111 | Hypothetical effector | 5 | 112 | 219 | 326 |
| ES52 | BEC1019_En_EX1_E_necator_CDS_consensus | Hypothetical effector | 6 | 113 | 220 | 327 |
| ES53 | KHJ35605EX1pr9_1_grape_c3345_consensus | Hypotheticai effector | 7 | 114 | 221 | 328 |
| GS1831 | TRINITY_DN10279_c0_g1 | glycosyl_partial | 8 | 115 | 222 | 329 |
| GS1841 | TRINITY_DN11780_c0_g2 | hypothetical_protein_BC1G_10461 | 9 | 116 | 223 | 330 |
| GS1813 | TRINITY_DN13134_c0_g1 | hypothetical_protein_BC1G_11193 | 10 | 117 | 224 | 331 |
| GS1847 | TRINITY_DN242_c0_g1 | hypothetical_protein_BcDW1_4798 | 11 | 118 | 225 | 332 |
| GS1871 | TRINITY_DN3028_c0_g1 | eka-like_protein | 12 | 119 | 226 | 333 |
| GS1874 | TRINITY_DN3931_c0_g2 | eka-like_protein | 13 | 120 | 227 | 334 |
| GS1836 | TRINITY_DN50_c0_g1 | Integral membrane protein/Pth11 homolog | 14 | 121 | 228 | 335 |
| GS1891 | TRINITY_DN5180_c0_g2 | eka-like_protein | 15 | 122 | 229 | 336 |
| GS1894 | TRINITY_DN5180_c2_g2 | eka-like_protein | 16 | 123 | 230 | 337 |
| GS1893 | TRINITY_DN5488_c0_g1 | C2H2 zinc finger domain | 17 | 124 | 231 | 338 |
| GS1895 | TRINITY_DN6811_c0_g1 | eka-like_protein | 18 | 125 | 232 | 339 |
| GS1867 | TRINITY_DN8189_c0_g1 | hypothetical_protein_BGT96224_Ac30495 | 19 | 126 | 233 | 340 |
| GS1803 | TRINITY_DN8745_c0_g1 | eka-like_protein | 20 | 127 | 234 | 341 |
| GS1811 | TRINITY_DN5577_c0_g1 | Acetyl-CoA carboxylase | 21 | 128 | 235 | 342 |
| GS1857 | TRINITY_DN4576_c0_g1 | Transcriptional adapter 2 | 22 | 129 | 236 | 343 |
| GS1842 | TRINITY_DN10665_c0_g1 | AP-1 complex subunit gamma-1 | 23 | 130 | 237 | 344 |
| GS1821 | TRINITY_DN792_c1_g1 | ABC transporter ATP-binding protein ARB1 | 24 | 131 | 238 | 345 |
| GS1881 | TRINITY_DN8265_c0_g1 | ADP-ribosylation factor 6 | 25 | 132 | 239 | 346 |
| GS1861 | TRINITY_DN44_c0_g1 | ADP-ribosylation factor-like protein 1 | 26 | 133 | 240 | 347 |
| GS1848 | TRINITY_DN5032_c0_g1 | ADP-ribosylation factor-like protein 3 | 27 | 134 | 241 | 348 |
| GS1846 | TRINITY_DN13355_c0_g1 | Calcium-transporting ATPase 2 | 28 | 135 | 242 | 349 |
| GS1838 | TRINITY_DN15214_c0_g1 | ATP synthase subunit alpha, mitochondrial | 29 | 136 | 243 | 350 |
| GS1800 | TRINITY_DN4135_c0_g1 | Protein BOB1 | 30 | 137 | 244 | 351 |
| GS1809 | TRINITY_DN359_c0_g1 | Cell division control protein 42 homolog | 31 | 138 | 245 | 352 |
| GS1817 | TRINITY_DN5091_c0_g1 | Cell division control protein 48 | 32 | 139 | 246 | 353 |
| GS1860 | TRINITY_DN5091_c0_g2 | Cell division control protein 48 | 33 | 140 | 247 | 354 |
| GS1825 | TRINITY_DN5692_c0_g1 | Serine/threonine-protein kinase cek1 | 34 | 141 | 248 | 355 |
| GS1879 | TRINITY_DN13247_c0_g1 | Chaperone-dependent E3 ubiquitin protein ligase | 35 | 142 | 249 | 356 |
| GS1849 | TRINITY_DN136_c0_g1 | Chitin synthase 8 | 36 | 143 | 250 | 357 |
| GS1829 | TRINITY_DN630_c0_g1 | Chitin synthase B | 37 | 144 | 251 | 358 |
| GS1828 | TRINITY_DN12200_c0_g1 | Putative coatomer subunit alpha | 38 | 145 | 252 | 359 |
| GS1886 | TRINITY_DN5521_c0_g1 | Serine/threonine-protein kinase cot-1 | 39 | 146 | 253 | 360 |
| GS1854 | TRINITY_DN15419_c0_g1 | Eburicol 14-alpha-demethylase | 40 | 147 | 254 | 361 |
| GS1892 | TRINITY_DN5044_c0_g2 | COP9 signalosome complex subunit 5 | 41 | 148 | 255 | 362 |
| GS1862 | TRINITY_DN8653_c0_g1 | ATP-dependent RNA helicase dbp10 | 42 | 149 | 256 | 363 |
| GS1815 | TRINITY_DN10773_c0_g2 | Protein sof1 | 43 | 150 | 257 | 364 |
| GS1833 | TRINITY_DN14786_c0_g1 | Eukaryotic translation Initiation factor 3 subunit G {ECO: 0000255|HAMAP-Rule: MF_03006} | 44 | 151 | 258 | 365 |
| GS1872 | TRINITY_DN5574_c0_g1 | Squalene monooxygenase | 45 | 152 | 259 | 366 |
| GS1873 | TRINITY_DN983_c0_g1 | Probable serine/threonine-protein kinase fhkC | 46 | 153 | 260 | 367 |
| GS1890 | TRINITY_DN12646_c0_g1 | Pre-rRNA-processing protein FHL1 | 47 | 154 | 261 | 368 |
| GS1889 | TRINITY_DN1159_c0_g2 | Fork head protein homolog 2 | 48 | 155 | 262 | 369 |
| GS1887 | TRINITY_DN9298_c0_g1 | Mitochondrial FAD carrier protein FLX1 | 49 | 156 | 263 | 370 |
| GS1812 | TRINITY_DN903_C0_g1 | Serine/threonine-protein kinase gad8 {ECO: 0000303|PubMed: 12805221} | 50 | 157 | 264 | 371 |
| GS1823 | TRINITY_DN6562_c0_g1 | Guanine nucleotide-binding protein subunit beta-like protein | 51 | 158 | 265 | 372 |
| GS1835 | TRINITY_DN908_c0_g1 | Probable glutamine--fructose-6-phosphate aminotransferase [isomerizing] | 52 | 159 | 266 | 373 |
| GS1804 | TRINITY_DN1072_c0_g1 | Probable very-long-chain (3R)-3-hydroxyacyl-CoA dehydratase | 53 | 160 | 267 | 374 |
| GS1814 | TRINITY_DN7110_c0_g1 | Importin subunit beta-3 | 54 | 161 | 268 | 375 |
| GS1807 | TRINITY_DN2836_c0_g1 | Inorganic pyrophosphatase | 55 | 162 | 269 | 376 |
| GS1866 | TRINITY_DN7252_c0_g1 | Proline-rich protein LAS17 | 56 | 163 | 270 | 377 |
| GS1820 | TRINITY_DN4890_c0_g2 | Mitochondrial carrier protein LEU5 | 57 | 164 | 271 | 378 |
| GS1810 | TRINITY_DN5084_c0_g1 | Lon protease homolog 2, peroxisomal | 58 | 165 | 272 | 379 |
| GS1869 | TRINITY_DN13703_c0_g1 | General alpha-glucoside permease | 59 | 166 | 273 | 380 |
| GS1863 | TRINITY_DN1982_c0_g3 | Chromatin remodeling factor mit1 | 60 | 167 | 274 | 381 |

TABLE 1A-continued

| Universal_ID | Starting Sequence ID | Gene Target | Target SEQ. ID NO. | Trig SEQ ID NO | RNA Trigger SEQ ID NO | RNA Reverse Complement Trigger SEQ ID NO |
|---|---|---|---|---|---|---|
| GS1875 | TRINITY_DN3329_c0_g1 | Mitochondrial RNA-splicing protein MRS3 | 61 | 168 | 275 | 382 |
| GS1801 | TRINITY_DN7405_c0_g1 | Methylsterol monooxygenase | 62 | 169 | 276 | 383 |
| GS1870 | TRINITY_DN8155_c0_g1 | Myosin-24 | 63 | 170 | 277 | 384 |
| GS1878 | TRINITY_DN8781_c0_g1 | [NU+] prion formation protein 1 | 64 | 171 | 278 | 385 |
| GS1805 | TRINITY_DN1240_c0_g1 | Neurofibromin | 65 | 172 | 279 | 386 |
| GS1808 | TRINITY_DN349_c0_g1 | Serine/threonine-protein kinase oca2 | 66 | 173 | 280 | 387 |
| GS1816 | TRINITY_DN304_c0_g1 | Plasma membrane ATPase | 67 | 174 | 281 | 388 |
| G51851 | TRINITY_DN2161_c0_g1 | Serine/threonine-protein kinase ppk4 | 68 | 175 | 282 | 389 |
| GS1883 | TRINITY_DN9865_c0_g1 | Nuclear and cytoplasmic polyadenylated RNA-binding protein PUB1 | 69 | 176 | 283 | 390 |
| GS1868 | TRINITY_DN8_c0_g1 | Glycine-rich RNA-binding protein 4, mitochondrial | 70 | 177 | 284 | 391 |
| GS1830 | TRINITY_DN7868_c0_g1 | Regulator of nonsense transcripts 1 homolog | 71 | 178 | 285 | 392 |
| GS1797 | TRINITY_DN140_c0_g1 | Ras-like GTP-binding protein RYL1 | 72 | 179 | 286 | 393 |
| GS1826 | TRINITY_DN9057_c0_g3 | Adenosylhomocysteinase | 73 | 180 | 287 | 394 |
| GS1806 | TRINITY_DN14393_c0_g1 | Serine/threonine-protein kinase SCH9 | 74 | 181 | 288 | 395 |
| GS1888 | TRINITY_DN7077_c0_g1 | Succinate dehydrogenase [ubiquinone] iron-sulfur subunit, mitochondrial | 75 | 182 | 289 | 396 |
| GS1865 | TRINITY_DN7321_c0_g5 | Protein transport protein SEC31 | 76 | 183 | 290 | 397 |
| GS1843 | TRINITY_DN2434_c0_g1 | Ubiquitin-like protein SMT3 | 77 | 184 | 291 | 398 |
| GS1880 | TRINITY_DN48_c0_g1 | Septin homolog spn1 | 78 | 185 | 292 | 399 |
| GS1882 | TRINITY_DN10172_c0_g1 | Serine/threonine-protein kinase SSN3 | 79 | 186 | 293 | 400 |
| GS1884 | TRINITY_DN2777_c0_g1 | Peptidyl-prolyl cis-trans isomerase ssp-1 | 80 | 187 | 294 | 401 |
| GS1838 | TRINITY_DN621_c0_g1 | Serine/threonine-protein kinase ssp1 | 81 | 188 | 295 | 402 |
| GS1834 | TRINITY_DN5858_c0_g1 | Tubulin beta-2 chain | 82 | 189 | 296 | 403 |
| GS1844 | TRINITY_DN11023_c0_g2 | Tubulin gamma chain | 83 | 190 | 297 | 404 |
| GS1845 | TRINITY_DN8561_c0_g1 | Singe-stranded TG1-3 DNA-binding protein | 84 | 191 | 298 | 405 |
| GS1798 | TRINITY_DN2036_c0_g1 | Tip elongation aberrant protein 1 | 85 | 192 | 299 | 406 |
| GS1799 | TRINITY_DN2602_c0_g1 | Transposon Tf2-6 polyprotein | 86 | 193 | 300 | 407 |
| GS1839 | TRINITY_DN8638_c0_g1 | Thioredoxin | 87 | 194 | 301 | 408 |
| GS1827 | TRINITY_DN449_c0_g1 | Ubiquitin-like modifier-activating enzyme 1 | 38 | 195 | 302 | 409 |
| GS1840 | TRINITY_DN10579_c0_g1 | Ubiquitin-conjugating enzyme E2-16 kDa | 39 | 196 | 303 | 410 |
| GS1864 | TRINITY_DN17_c0_g1 | NEDD8-conjugating enzyme UBC12 | 90 | 197 | 304 | 411 |
| GS1850 | TRINITY_DN7419_c0_g2 | Ubiquitin-conjugating enzyme E2-34 kDa | 91 | 198 | 305 | 412 |
| GS1837 | TRINITY_DN1272_c0_g1 | UDP-glucose: glycoprotein glucosyltransferase 1 | 92 | 199 | 306 | 403 |
| GS1824 | TRINITY_DN7769_c0_g1 | WD repeat domain-containing protein 83 | 93 | 200 | 307 | 414 |
| GS1832 | TRINITY_DN10280_c0_g1 | COBW domain-containing protein DDB_G0274527 | 94 | 201 | 308 | 415 |
| GS1852 | TRINITY_DN4809_c0_g1 | PA-phosphatase related-family protein DDB_G0275547 | 95 | 202 | 309 | 416 |
| GS1858 | TRINITY_DN2978_c0_g1 | Uncharacterized ABC transporter ATPbinding protein C29A3.09c | 96 | 203 | 310 | 417 |
| GS1853 | TRINITY_DN13341_c0_g1 | Uncharacterized WD repeat-containing protein C17D11.16 | 97 | 204 | 311 | 418 |
| GS1877 | TRINITY_DN14254_c0_g1 | Uncharacterized ATP-dependent helicase C582.10c | 93 | 205 | 312 | 419 |
| GS1822 | TRINITY_DN15159_c0_g1 | Putative phospholipid-transporting ATPase C6C3.06c | 99 | 206 | 313 | 420 |
| GS1859 | TRINITY_DN6014_c0_g1 | Citrate/oxoglutarate carrier protein | 100 | 207 | 314 | 421 |
| GS1802 | TRINITY_DN8119_c0_g1 | Uncharacterized oxidoreductase C736.13 | 101 | 208 | 315 | 422 |
| GS1819 | TRINITY_DN388_c0_g1 | Putative ATP-dependent RNA helicase PB1A10.06c | 102 | 209 | 316 | 423 |
| GS1876 | TRINITY_DN3770_c0_g1 | Uncharacterized transcriptional regulatory protein YKL222C | 103 | 210 | 317 | 424 |
| GS1796 | TRINITY_DN12735_c0_g1 | Putative aldehyde dehydrogenase-like protein C922.07c | 104 | 211 | 318 | 425 |
| GS1855 | TRINITY_DN14494_c0_g1 | Golgi apyrase | 105 | 212 | 319 | 426 |
| GS1885 | TRINITY_DN9345_c0_g1 | ribosomal processing RNA binding nucleolar protein | 106 | 213 | 320 | 427 |
| GS1856 | TRINITY_DN8113_c0_g1 | Zinc finger and SCAN domain-containing protein 20 | 107 | 214 | 321 | 428 |

TABLE 1B

| Universal_ID | Starting Sequence ID | Gene target | Target SEQ. ID NO. | Trig SEQ ID NO | RNA Trigger SEQ ID NO | RNA Reverse Complement Trigger SEQ ID NO |
|---|---|---|---|---|---|---|
| GS3452 | TRINITY_GG_9583_c0_g1_i2 | Bcin09g02820 | 429 | 643 | 857 | 1071 |
| GS3453 | TRINITY_GG_1634_c0_g1_i1 | Bcin12g00720 | 430 | 644 | 858 | 1072 |
| GS3454 | TRINITY_GG_1638_c0_g1_i1 | Bcin12g00750 | 431 | 645 | 859 | 1073 |
| GS3455 | TRINITY_GG_539_c0_g1_i1 | XM_001550365.2 | 432 | 646 | 860 | 1074 |
| GS3456 | TRINITY_GG_1533_c0_g1_i1 | XM_001551801.2 | 433 | 647 | 361 | 1075 |
| GS3457 | TRINITY_GG_8630_c0_g1_i1 | XM_001552213.2 | 434 | 648 | 862 | 1076 |
| GS3458 | TRINITY_GG_2453_c0_g1_i1 | XM_024692064.1 | 435 | 649 | 863 | 1077 |
| GS3459 | TRINITY_GG_6063_c0_g1_i1 | NP_013214.1 | 436 | 650 | 864 | 1078 |
| GS3460 | TRINITY_GG_1206_c0_g1_i1 | NP_014893.1 | 437 | 651 | 865 | 1079 |
| GS3451 | TRINITY_GG_13979_c0_g1_i2 | XP_023430615.1 | 438 | 652 | 366 | 1080 |
| GS3462 | TRINITY_GG_10946_c1_g1_i3 | XP_023432744.1 | 439 | 653 | 867 | 1081 |
| GS3463 | TRINITY_GG_329_c1_g1_i1 | XP_037204365.1 | 440 | 654 | 868 | 1082 |
| GS3464 | TRINITY_GG_13219_c0_g1_i1 | XP_747810.1 | 441 | 655 | 869 | 1083 |
| GS3465 | TRINITY_GG_2412_c0_g1_i2 | XP_748915.1 | 442 | 656 | 870 | 1084 |
| GS3466 | TRINITY_GG_7858_c0_g1_i1 | XP_749450.1 | 443 | 657 | 871 | 1085 |
| GS3467 | TRINITY_GG_5538_c0_g1_i1 | XP_750702.1 | 444 | 658 | 872 | 1086 |
| GS3468 | TRINITY_GG_12815_c0_g1_i1 | XP_750742.1 | 445 | 659 | 873 | 1087 |
| GS3459 | TRINITY_GG_7856_c1_g1_i1 | XP_754594.2 | 446 | 660 | 374 | 1088 |
| GS3470 | TRINITY_GG_6394_c3_g1_i1 | XP_754804.1 | 447 | 661 | 875 | 1089 |
| GS3471 | TRINITY_GG_7871_c0_g1_i2 | XP_755571.1 | 448 | 662 | 876 | 1090 |
| GS3472 | TRINITY_GG_8991_c0_g1_i1 | PTHR21229; LUNG_SEVEN_TRANSMEMBRANE_RECEPTOR | 449 | 663 | 877 | 1091 |
| GS3473 | TRINITY_GG_14127_c0_g1_i1 | PTHR21143; INVERTEBRATE_GUSTATORY_RECEPTOR | 450 | 664 | 878 | 1092 |
| GS3474 | TRINITY_GG_3099_c0_g1_i1 | PTHR32546; G-PROTEIN_COUPLED_RECEPTOR_158-RELATED | 451 | 665 | 379 | 1093 |
| GS3475 | TRINITY_GG_2210_c0_g1_i1 | PTHR24247; 5-HYDROXYTRYPTAMINE_RECEPTOR | 452 | 666 | 880 | 1094 |
| GS3476 | TRINITY_GG_855_c0_g1_i1 | PTHR22943; 7-TRANSMEMBRANE_DOMAIN_RECEPTOR_C.ELE6ANS | 453 | 667 | 881 | 1095 |
| GS3477 | TRINITY_GG_815_c0_g1_i1 | PTHR22752; G_PROTEIN-COUPLED_RECEPTOR | 454 | 668 | 882 | 1096 |
| GS3478 | TRINITY_GG_10153_c0_g1_i3 | RL8B_YEAST.UniProt; RL8_SCHPO.UniProt; PF01248.27; Ribosomal_L7Ae | 455 | 669 | 883 | 1097 |
| GS3479 | TRINITY_GG_10658_c2_g1_i1 | PF09351.11; DUF1993 | 456 | 670 | 884 | 1098 |
| GS3523 | TRINITY_GG_12698_c1_g1_i1 | PTHR12011_SF285; ADHESION_G_PROTEIN_COUPLED_RECEPTOR_G3 | 472 | 686 | 900 | 1114 |
| GS3524 | TRINITY_GG_13859_c0_g1_i1 | EV44_g4685 | 473 | 687 | 901 | 1115 |
| GS3525 | TRINITY_GG_14723_c0_g1_i1 | EV44_g0100 | 474 | 688 | 902 | 1116 |
| GS3526 | TRINITY_GG_15018_c0_g1_i1 | EV44_g5339 | 475 | 689 | 903 | 1117 |
| GS3600 | ES45-3prime | Hypothetical effector | 476 | 690 | 904 | 1118 |
| GS3601 | GS1798_101_to_501 | EV44_g1088 | 477 | 691 | 905 | 1119 |
| GS3602 | GS1798_124_to_474 | EV44_g1088 | 478 | 692 | 906 | 1120 |
| GS3603 | GS1798_149_to_449 | EV44_g1088 | 479 | 693 | 907 | 1121 |
| GS3605 | GS1817_123_to_473 | EV44_g1406 | 481 | 695 | 909 | 1123 |
| GS3606 | GS1817_148_to_448 | EV44_g1406 | 482 | 696 | 910 | 1124 |
| GS3609 | GS1827_122_to_472 | None | 485 | 699 | 913 | 1127 |
| GS3610 | GS1827_147_to_447 | None | 486 | 700 | 914 | 1128 |
| GS3612 | GS1827_97_to_497 | None | 488 | 702 | 916 | 1130 |
| GS3613 | GS1845_109_to_459 | EV44_g2059 | 489 | 703 | 917 | 1131 |
| GS3614 | GS1845_134_to_434 | EV44_g2059 | 490 | 704 | 918 | 1132 |
| GS3615 | GS1845_159_to_409 | EV44_g2059 | 491 | 705 | 919 | 1133 |
| GS3616 | GS1845_84_to_484 | EV44_g2059 | 492 | 706 | 920 | 1134 |
| GS3617 | GS1875_106_to_356 | EV44_g5757 | 493 | 707 | 921 | 1135 |
| GS3618 | GS1875_31_to_431 | EV44_g5757 | 494 | 708 | 922 | 1136 |
| GS3619 | GS1875_56_to_406 | EV44_g5757 | 495 | 709 | 923 | 1137 |
| GS3620 | GS1875_81_to_381 | EV44_g5757 | 496 | 710 | 924 | 1138 |
| GS3622 | GS1885_28_to_428 | EV44_g0930 | 497 | 711 | 925 | 1139 |
| GS3623 | GS1885_53_to_403 | EV44_g0930 | 498 | 712 | 926 | 1140 |
| GS3625 | TRINITY_GG_11550_c0_g1_i1_339_to_738 | EV44_g0152 | 499 | 713 | 927 | 1141 |
| GS3626 | TRINITY_GG_11550_c0_g1_i1_364_to_713 | EV44_g0152 | 500 | 714 | 928 | 1142 |
| GS3627 | TRINITY_GG_11550_c0_g1_i1_389_to_688 | EV44_g0152 | 501 | 715 | 929 | 1143 |
| GS3628 | TRINITY_GG_11550_c0_g1_i1_414_to_663 | EV44_g0152 | 502 | 716 | 930 | 1144 |
| GS3672 | KHJ30116.1 | EV44_g4367 | 503 | 717 | 931 | 1145 |
| GS3673 | KHJ32686.1 | EV44_g1197 | 504 | 718 | 932 | 1146 |
| G53674 | KHJ34469.1 | EV44_g4639 | 505 | 719 | 933 | 1147 |
| G53915 | TRINITY_GG_6507_c0_g1_i1 | EV44_g0067 | 506 | 720 | 934 | 1148 |
| GS3916 | TRINITY_GG_13077_c0_g1_i1 | EV44_g0082 | 507 | 721 | 935 | 1149 |
| GS3917 | TRINITY_GG_13410_c0_g1_i1 | EV44_g0183 | 508 | 722 | 936 | 1150 |
| GS3919 | TRINITY_GG_15428_c0_g1_i1 | EV44_g0367 | 509 | 723 | 937 | 1151 |

TABLE 1B-continued

| Universal_ID | Starting Sequence ID | Gene target | Target SEQ. ID NO. | Trig SEQ ID NO | RNA Trigger SEQ ID NO | RNA Reverse Complement Trigger SEQ ID NO |
|---|---|---|---|---|---|---|
| GS3920 | TRINITY_GG_2018_c0_g1_i1 | EV44_g0437 | 510 | 724 | 938 | 1152 |
| GS3921 | TRINITY_GG_2433_c0_g1_i1 | EV44_g0595 | 511 | 725 | 939 | 1153 |
| GS3922 | TRINITY_GG_10967_c0_g1_i1 | EV44_g0628 | 512 | 726 | 940 | 1154 |
| G53923 | TRINITY_GG_2660_c1_g1_i1 | EV44_g0669 | 513 | 727 | 941 | 1155 |
| GS3924 | TRINITY_GG_13965_c0_g1_i1 | EV44_g0714 | 514 | 728 | 942 | 1156 |
| GS3925 | TRINITY_GG_11546_c5_g1_i1 | EV44_g0719 | 515 | 729 | 943 | 1157 |
| GS3926 | TRINITY_GG_14253_c0_g1_i1 | EV44_g0824 | 516 | 730 | 944 | 1158 |
| GS3927 | TRINITY_GG_10689_c0_g1_i1 | EV44_g0885 | 517 | 731 | 945 | 1159 |
| GS3928 | TRINITY_GG_4957_c1_g1_i1 | EV44_g1092 | 518 | 732 | 946 | 1160 |
| GS3929 | TRINITY_GG_13246_c0_g1_i1 | EV44_g1137 | 519 | 733 | 947 | 1161 |
| GS3930 | TRINITY_GG_6297_c1_g1_i1 | EV44_g1181 | 520 | 734 | 948 | 1162 |
| GS3931 | TRINITY_GG_12374_c4_g1_i1 | EV44_g1198 | 521 | 735 | 949 | 1163 |
| GS3932 | TRINITY_GG_4935_c0_g1_i1 | EV44_g1206 | 522 | 736 | 950 | 1164 |
| GS3934 | TRINITY_GG_4392_c0_g1_i1 | EV44_g1233 | 523 | 737 | 951 | 1165 |
| GS3935 | TRINITY_GG_15719_c1_g1_i1 | EV44_g1283 | 524 | 738 | 952 | 1166 |
| GS3936 | TRINITY_GG_1_c0_g1_i1 | EV44_g1305 | 525 | 739 | 953 | 1167 |
| GS3937 | TRINITY_GG_4130_c1_g1_i3 | EV44_g1350 | 526 | 740 | 954 | 1168 |
| GS3938 | TRINITY_GG_4831_c0_g1_i2 | EV44_g1365 | 527 | 741 | 955 | 1169 |
| GS3939 | TRINITY_GG_14414_c0_g1_E1 | EV44_g1398 | 528 | 742 | 956 | 1170 |
| GS2382 | CYP51_consensus | CYP51 | 544 | 758 | 972 | 1186 |
| GS2384 | CYP51_consensus | CYP51 | 545 | 759 | 973 | 1187 |
| GS2655 | TRINITY_DN10412_c0_g1 | XM_001588131.1; XM_654687.1 | 547 | 761 | 975 | 1189 |
| GS2656 | TRINITY_DN10461_c0_g1 | XM_001598171.1 | 548 | 762 | 976 | 1190 |
| GS2660 | TRINITY_DN11447_c0_g1 | XM_001591118.1 | 550 | 764 | 978 | 1192 |
| GS2661 | TRINITY_DN114_c0_g1 | XM_001588718.1 | 551 | 765 | 979 | 1193 |
| GS2666 | TRINITY_DN11662_c0_g2 | wetA | 553 | 767 | 981 | 1195 |
| GS2668 | TRINITY_DN11775_c0_g1 | XM_001590162.1 | 555 | 769 | 983 | 1197 |
| GS2674 | TRINITY_DN12400_c0_g1 | XM_001588131.1 | 558 | 772 | 986 | 1200 |
| GS2679 | TRINITY_DN12771_c0_g1 | XM_001590702.1 | 560 | 774 | 988 | 1202 |
| GS2680 | TRINITY_DN12779_c0_g1 | XM_001228352.1 | 561 | 775 | 989 | 1203 |
| GS2684 | TRINITY_DN1304_c0_g1 | XM_001593084.1 | 562 | 776 | 990 | 1204 |
| GS2685 | TRINITY_DN13118_c0_g1 | XM_001551736.2 | 563 | 777 | 991 | 1205 |
| GS2686 | TRINITY_DN13133_c0_g1 | XM_001556793.2 | 564 | 778 | 992 | 1206 |
| GS2690 | TRINITY_GG_10934_c0_g1_i1 | XM_001559567.2 | 565 | 779 | 992 | 1207 |
| GS2691 | TRINITY_DN13338_c0_g1 | AF439265.1 | 566 | 780 | 994 | 1208 |
| GS2732 | TRINITY_DN2577_c0_g1 | XM_001558623.2 | 568 | 782 | 996 | 1210 |
| GS2736 | TRINITY_DN3050_c0_g1 | XM_957858.3 | 569 | 783 | 997 | 1211 |
| GS2788 | TRINITY_DN8972_c0_g1 | XM_001560000.2 | 570 | 784 | 998 | 1212 |
| GS2799 | TRINITY_DN9831_c0_g1 | XM_001594710.1 | 571 | 785 | 999 | 1213 |
| GS2804 | TRINITY_DN8376_c0_g1 | X99732; X99732.1 | 572 | 786 | 1000 | 1214 |
| GS3295 | Rule_ES43-ES45_segien_125_ES43_ES45_five_prime | EV44_g0152-Effector_EC1 | 573 | 787 | 1001 | 1215 |
| GS3297 | Rule_ES43-ES45_segien_175_ES43_ES45_five_prime | EV44_g0152-Effector_EC1 | 575 | 789 | 1003 | 1217 |
| GS3298 | Rule_ES43-ES45_segien_200_ES43_ES45_five_prime | EV44_g0152-Effector_EC1 | 576 | 790 | 1004 | 1218 |
| GS3299 | TRINITY_GG_10948_c0_g1_i1 | AAG25917 | 577 | 791 | 1005 | 1219 |
| GS3300 | TRINITY_GG_10977_c0_g1_i2 | briA | 578 | 792 | 1006 | 1220 |
| GS3301 | TRINITY_GG_11550_c0_g1_i1 | EV44_g0152-Effector_EC1 | 579 | 793 | 1007 | 1221 |
| GS3302 | TRINITY_GG_11550_c0_g1_i1-ES45N-250 bp | EV44_g0152-Effector_EC1 | 580 | 794 | 1008 | 1222 |
| GS3303 | TRINITY_GG_11550_c0_g1_i1-ES45N-300 bp | EV44_g0152-Effector_EC1 | 581 | 795 | 1009 | 1223 |
| GS3304 | TRINITY_GG_11550_c0_g1_i1-ES45N-350 bp | EV44_g0152-Effector_EC1 | 582 | 796 | 1010 | 1224 |
| GS3305 | TRINITY_GG_11727_c0_g1_i1 | XM_001559385.2 | 583 | 797 | 1011 | 1225 |
| GS3306 | TRINITY_GG_12284_c0_g1_i2 | EV44_g1175 | 584 | 798 | 1012 | 1226 |
| GS3310 | TRINITY_GG_12822_c0_g1_i1 | XM_001589331.1 | 588 | 802 | 1016 | 1230 |
| GS3311 | TRINITY_GG_13001_c1_g1_i2 | EEH21650 | 589 | 803 | 1017 | 1231 |
| GS3312 | TRINITY_GG_13208_c0_g1_i1 | YGL001C-MONOMER | 590 | 804 | 1018 | 1232 |
| GS3313 | TRINITY_GG_13258_c0_g1_i2 | XM_001932887.1 | 591 | 805 | 1019 | 1233 |
| GS3314 | TRINITY_GG_13506_c0_g1_i1 | XM_002482673.1 | 592 | 806 | 1020 | 1234 |
| GS3317 | TRINITY_GG_14744_c1_g1_i1 | XP_001272602 | 595 | 809 | 1023 | 1237 |
| GS3319 | TRINITY_GG_15444_c0_g1_i1 | XM_001597869.1 | 597 | 811 | 1025 | 1239 |
| GS3320 | TRINITY_GG_15529_c1_g1_i1 | XP_001938513 | 598 | 812 | 1026 | 1240 |
| GS3321 | TRINITY_GG_15532_c0_g1_i1 | XM_001272020.1 | 599 | 813 | 1027 | 1241 |
| G53322 | TRINITY_GG_15624_c0_g1_i1 | XM_747336.1 | 600 | 814 | 1028 | 1242 |
| GS3323 | TRINITY_GG_1604_c0_g1_i1 | YML008C-MONOMER30-188 | 601 | 815 | 1029 | 1243 |
| GS3324 | TRINITY_GG_1742_c1_g1_i1 | XP_001593480 | 602 | 316 | 1030 | 1244 |
| GS3325 | TRINITY_GG_1849_c0_g1_i2 | XM_024691832.1 | 603 | 817 | 1031 | 1245 |
| GS3326 | TRINITY_GG_2123_c0_g1_i1 | XP_001548642 | 604 | 818 | 1032 | 1246 |

TABLE 1B-continued

| Universal_ID | Starting Sequence ID | Gene target | Target SEQ. ID NO. | Trig SEQ ID NO | RNA Trigger SEQ ID NO | RNA Reverse Complement Trigger SEQ ID NO |
|---|---|---|---|---|---|---|
| GS3328 | TRINITY_GG_2845_c0_g1_i1 | EU311400 | 606 | 820 | 1034 | 1248 |
| GS3331 | TRINITY_GG_313_c0_g1_i1 | YHR190W-MONOMER | 609 | 823 | 1037 | 1251 |
| GS3333 | TRINITY_GG_4039_c0_g1_i1 | XM_001594601.1 | 611 | 825 | 1039 | 1253 |
| GS3334 | TRINITY_GG_4266_c0_g1_i1 | XM_001586194.1 | 612 | 826 | 1040 | 1254 |
| GS3335 | TRINITY_GG_4460_c0_g1_i1 | XM_024695332.1 | 613 | 827 | 1041 | 1255 |
| GS3336 | TRINITY_GG_4682_c0_g1_i2 | YGR060W-MONOMER | 614 | 828 | 1042 | 1256 |
| GS3337 | TRINITY_GG_4687_c0_g1_i1 | YGR175C-MONOMER | 615 | 829 | 1043 | 1257 |
| GS3339 | TRINITY_GG_5176_c0_g1_i3 | XM_024691565.1 | 616 | 830 | 1044 | 1258 |
| GS3340 | TRINITY_GG_554_c0_g1_i1 | YNR043W-MONOMER | 617 | 831 | 1045 | 1259 |
| GS3341 | TRINITY_GG_5647_c0_g1_i1 | AF119671.1 | 618 | 832 | 1046 | 1260 |
| GS3343 | TRINITY_GG_6137_c0_g1_i1 | EV44_g1104 | 619 | 333 | 1047 | 1261 |
| GS3344 | TRINITY_GG_6245_c1_g1_i1 | XM_024695160.1 | 620 | 834 | 1048 | 1262 |
| GS3345 | TRINITY_GG_6512_c0_g1_i1 | XM_653434.1 | 621 | 835 | 1049 | 1263 |
| GS3346 | TRINITY_GG_6816_c0_g1_i1 | XM_001585206.1 | 622 | 336 | 1050 | 1264 |
| GS3347 | TRINITY_GG_7369_c0_g1_i2 | XM_024695697.1 | 623 | 837 | 1051 | 1265 |
| GS3351 | TRINITY_GG_88_c0_g1_i1 | XM_001555987.2 | 624 | 838 | 1052 | 1266 |
| GS3352 | TRINITY_GG_8985_c0_g1_i1 | XM_001553895.2 | 625 | 839 | 1053 | 1267 |
| GS3353 | TRINITY_GG_904_c7_g1_i1 | XM_001551736.2; EV44_g1817 | 626 | 840 | 1054 | 1268 |
| GS3354 | TRINITY_GG_9180_c0_g1_i1 | XM_001549299.2 | 627 | 841 | 1055 | 1269 |
| GS3355 | TRINITY_GG_9281_c0_g1_i1 | XM_001588685.1 | 628 | 842 | 1056 | 1270 |
| GS3356 | TRINITY_GG_9302_c1_g1_i1 | YMR208W-MONOMER | 629 | 843 | 1057 | 1271 |
| GS3357 | TRINITY_GG_9525_c1_g1_i1 | XP_962652; XM_001931138.1 | 630 | 844 | 1058 | 1272 |
| GS3358 | TRINITY_GG_9786_c0_g1_i1 | XM_659054.1; EV44_g1799 | 631 | 845 | 1059 | 1273 |
| GS3359 | TRINITY_GG_9842_c0_g1_i1 | XM_001932383.1 | 632 | 846 | 1060 | 1274 |
| GS3360 | TRINITY_GG_9884_c0_g1_i1 | YLR450W-MONOMER; YML075C-MONOMER | 633 | 847 | 1061 | 1275 |
| GS3361 | TRINITY_GG_990_c0_g1_i1 | XM_001935652.1 | 634 | 848 | 1062 | 1276 |
| GS3362 | TRINITY_GG_11550_c0_g1_i1-ES45N-400 bp | EV44_g0152-Effector_EC1 | 635 | 349 | 1063 | 1277 |
| GS3445 | TRINITY_GG_2908_c1_g1_i1 | Bcin01g08230 | 636 | 850 | 1064 | 1278 |
| GS3446 | TRINITY_GG_10521_c1_g1_i1 | Bcin02g01540 | 637 | 851 | 1065 | 1279 |
| GS3447 | TRINITY_GG_11315_c0_g1_i2 | Bcin03g05090 | 638 | 852 | 1066 | 1280 |
| GS3448 | TRINITY_GG_6645_c0_g1_i1 | Bcin03g05360 | 639 | 853 | 1067 | 1281 |
| GS3449 | TRINITY_GG_4880_c0_g1_i1 | Bcin05g06320 | 640 | 854 | 1068 | 1282 |
| GS3450 | TRINITY_GG_2174_c1_g1_i1 | Bcin07g02480 | 641 | 855 | 1069 | 1283 |
| GS3451 | TRINITY_GG_2060_c0_g1_i1 | Bcin07g05520 | 642 | 856 | 1070 | 1284 |

Results

The potential of endogenous application of dsRNA to control *E. necator* was demonstrated using ES43 (497 bp Cyp51-dsRNA; SEQ ID NO: 108), which targets the fungal cytochrome P450 lanosterol C-14a-demethylase, required for biosynthesis of fungal ergosterol. Leaf disks were sprayed with ES43-dsRNA and fungal development was evaluated at 3-, 6-, 9- and 12-dpi. At nine-dpi ES43-dsRNA-treated leaf disks at 10 and 25 ppm revealed a significant decrease of powdery mildew development on leaf disks compared to both untreated and non-dsRNA targets (FIG. 1).

Example 2

Leaf Disc Assay Demonstrating Activity of Trigger Sequences

Leaf disc bioassay was slightly modified from wet inoculum (Example 1) to dry inoculum (Example 2), to mimic the natural infestation observed on grape fields.

TABLE 2

LSMeans differences Dunnett's for each of the ES43-dsRNA treated individual runs showing significant differences compared with negative controls.

| | Level | −Level | Difference | Std Err Dif | Lower CL | Upper CL | p-Value |
|---|---|---|---|---|---|---|---|
| Run1 | [ES43]10 | [GS4]25 | −61.5000 | 12.84794 | −94.1382 | −28.8618 | 0.0003* |
| | [ES43]25 | [GS4]25 | −49.1667 | 12.84794 | −81.8049 | −16.5284 | 0.0029* |
| | [UTC]0 | [GS4]25 | −10.8333 | 12.84794 | −43.4716 | 21.8049 | 0.7369 |
| Run 2 | [ES43]10 | GS4]25 | 10.0000 | 10.12037 | −15.1292 | 35.1292 | 0.6385 |
| | [ES43]25 | [GS4]25 | −26.3750 | 10.12037 | −51.5042 | −1.2458 | 0.0381* |
| | [UTC]0 | [GS4]25 | 3.8750 | 10.12037 | −21.2542 | 29.0042 | 0.9632 |
| Run 3 | [ES43]10 | [GS145]25 | −24.0000 | 6.395616 | −39.4131 | −8.5869 | 0.0011* |
| | [ES43]25 | [GS145]25 | −17.0625 | 6.395616 | −32.4756 | −1.6494 | 0.0264* |
| | [UTC]0 | [GS145]25 | 0.4375 | 6.395616 | −14.9756 | 15.8506 | 0.9998 |

Materials
Inoculum

*E. necator* isolate LNYM, was used for inoculations. Conidial suspensions were prepared and maintained on surface-sterilized detached leaves of *Vitis vinifera* Chardonnay cultivar according to Cadle-Davidson et al. 2016, Horticulture Research, 3, and Lance Cadle-Davidson et al., 2016. Lessons from a phenotyping center revealed by the genome-guided mapping of powdery mildew resistance loci. Phytopathology 106:1159-1169. Inoculations were performed by placing 1.3-m-tall settling tower over a tray, containing 351 leaf discs, and tapping one to two grape leaves over the top of the settling tower. Cover slips were placed on four quadrants of the tray to further quantify spore landing and germination rate.

Plant Tissue

*V. vinifera* plants of the Chardonnay cultivar growing under greenhouse conditions in Geneva (NY) were used to test endogenous application of naked dsRNA. Leaf discs (1 cm$^2$) from young leaves were used to test the ability of exogenously applied, gene specific dsRNAs to decrease powdery mildew disease severity. Leaves were collected, sterilized, and stored at 4° C. in a plastic box until further analysis. The surface of leaves was sterilized by submersing the leaves into a 10% bleach solution for 2 min with constant agitation and then washed three times in sterile distilled water for at least 1 min. After sterilization, excess moisture was removed by placing the leaves on a sterile paper towel inside of a laminar flow hood.

Methods
dsRNA Treatments and Inoculation dsRNA treatments were sprayed ~6" away from the leaf using an atomizer to get a fine mist of small droplets covering the desired area. Sixteen leaf disks (subsamples) obtained from sixteen leaves of a similar physiological age were used for each treatment combination.

Treatments were applied on leaf discs (subsamples) and collected. Subsamples were collected using a 1-cm corkborer and randomly placed on an acrylic tray (351 samples) containing 1% water agar. After 24 hours post-dsRNA-treatment leaf discs were inoculated using the settling tower. Trays were immediately covered to maintain high humidity, at 23° C. with a 12-hr photoperiod with 45 mmol*m2*s−1 of PAR during 12-days post inoculation (dpi).

Automated Phenotyping System (APS)

Leaf disc samples were imaged using a high-resolution robotic camera (BlackBird) with a macro-focusing lens (800 sub-images per disk). Images were taken and stacked into a single fully focused image through a focus-stacking algorithm (see Bierman et al. 2019). Disease severity (%) was then calculated using a neural network developed at the USDA (Dr. Lance Cadle-Davidson), based on the presence or absence of *E. necator* hyphae in each subimage. Disease severity was assessed comparing dsRNA-treated samples with a non-target dsRNA sequence (GS145) and untreated control (UTC). GS145 was used as negative sequence control in each experiment, and UTC used for statistical analyses.

Results

Figure 2:
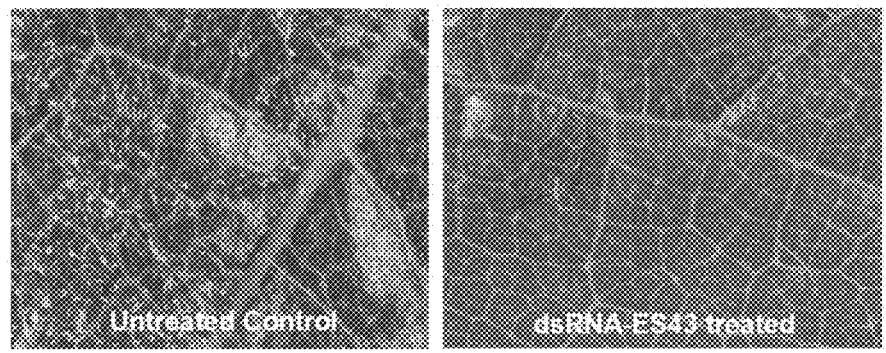
FIG. 2 shows a photograph of dsRNA-treated leaf discs compared to the untreated control. Hyphal growth was collected at 3-, 6-, 9- and 12-days after inoculation.

Decrease in disease severity was determined by quantifying the percentage of hyphal growth of dsRNA-treated leaf discs compared to the untreated control as shown in Table 3. Hyphal growth was collected at 3-, 6-, 9- and 12-days after inoculation. Exemplary images are shown in FIG. 2. Analyses were performed when hyphal growth for untreated control reached ≥50% (noted as time point 1 (TP1)). Samples for which no hyphal reduction was observed are marked as "n.d." Best performers are indicated based on significant hyphal reduction compared to untreated control (>40%) at one and/or two time points (TP1 & TP2) over at least three different runs. Thirteen gene targets exhibited significant (p<0.05) decrease of fungal growth (>40%) at least in one time point (TP), as shown in Table 3. Such active gene targets are marked as "Y" in the Active column of Table 3. Many targets did not statistically significantly decrease fungal growth at the >40% threshold for activity compared to untreated control and are marked as "N" in the Active column of Table 3.

Table 3 dsRNA sequences tested to control *E. necator* on grapevine leaves. Percentage of decrease in disease severity relative to untreated control for each time point (TP) is shown. Values are expressed as the percentage of decrease (±SE). Statistical significance at p<0.05, Dunnett test.

TABLE 2

| | | % decrease =/− SE | | | |
|---|---|---|---|---|---|
| ID | Active | TP1 | TP1 p-value | TP2 | TP2 p-value |
| ES43 | Y | 41 ± 3 | 0.032 | 28 ± 5 | 0.087 |
| ES45 | Y | 41 ± 5 | 0.011 | 31 ± 7 | 0.048 |
| ES46 | N | 6 ± 0 | 1.000 | 5 ± 0 | 1.000 |
| ES48 | N | 15 ± 6 | 0.567 | 1 ± 3 | 0.996 |
| ES49 | N | 9 ± 1 | 1.000 | 6 ± 3 | 1.000 |
| ES52 | N | 6 ± 1 | 1.000 | 6 ± 2 | 1.000 |
| ES53 | N | 4 ± 1 | 1.000 | n.d. | 1.000 |
| GS1796 | N | n.d. | — | 1 ± 8 | 1.000 |
| GS1798 | Y | 44 ± 4 | 0.011 | 47 ± 5 | 0.189 |
| GS1799 | N | 16 ± 5 | 0.916 | 8 ± 6 | 0.921 |
| GS1800 | N | 22 ± 6 | 0.307 | 25 ± 8 | 0.215 |
| GS1806 | Y | 34 ± 7 | 0.012 | 21 ± 7 | 0.085 |
| GS1807 | N | n.d. | — | n.d. | — |
| GS1810 | N | n.d. | — | n.d. | — |
| GS1811 | N | n.d. | — | n.d. | — |
| GS1813 | N | 11 ± 5 | 0.974 | 4 ± 5 | 1.000 |
| GS1814 | N | 8 ± 4 | 0.985 | n.d. | — |
| GS1816 | Y | 61 ± 2 | 0.013 | 50 ± 7 | <.0001 |
| GS1817 | Y | 52 ± 2 | 0.032 | 49 ± 6 | 0.001 |
| GS1818 | N | 32 ± 4 | 0.167 | 20 ± 6 | 0.127 |
| GS1819 | N | 12 ± 6 | 0.995 | 8 ± 9 | 0.997 |
| GS1820 | N | 23 ± 4 | 0.584 | 10 ± 6 | 0.898 |
| GS1821 | N | 29 ± 5 | 0.118 | 19 ± 6 | 0.328 |
| GS1822 | N | 23 ± 5 | 0.207 | 16 ± 4 | 0.277 |
| GS1823 | N | 31 ± 8 | 0.085 | 26 ± 8 | 0.145 |
| GS1824 | N | 26 ± 7 | 0.257 | 19.5 ± 8 | 0.477 |
| GS1825 | N | 28 ± 5 | 0.069 | 18 ± 6 | 0.198 |
| GS1826 | N | 19 ± 6 | 0.287 | 6 ± 5 | 1.000 |
| GS1827 | Y | 45 ± 2 | 0.016 | 40 ± 4 | 0.379 |
| GS1829 | Y | 50 ± 2 | 0.0002 | 32 ± 9 | 0.062 |
| GS1830 | N | 36 ± 4 | 0.161 | 24 ± 5 | 0.034 |
| GS1831 | N | 34 ± 6 | 0.098 | 19 ± 6 | 0.106 |
| GS1832 | N | 28 ± 6 | 0.088 | 31 ± 7 | 0.015 |
| GS1833 | N | 12 ± 5 | 0.892 | 7 ± 5 | 0.941 |
| GS1834 | N | 8 ± 4 | 1.000 | 15 ± 6 | 0.999 |
| GS1835 | N | 25 ± 6 | 0.148 | 24 ± 6 | 0.061 |
| GS1836 | N | 23 ± 6 | 0.233 | 22 ± 6 | 0.113 |
| GS1837 | N | 15 ± 7 | 0.917 | 18 ± 8 | 0.608 |
| GS1838 | N | n.d. | — | n.d. | — |
| GS1839 | N | 20 ± 7 | 0.715 | 18 ± 7 | 0.516 |
| GS1840 | N | 21 ± 6 | 0.718 | 11 ± 10 | 0.911 |
| GS1841 | N | n.d. | — | n.d. | — |
| GS1842 | N | 6 ± 7 | 1.000 | n.d. | — |
| GS1843 | N | 20 ± 5 | 0.989 | 16 ± 8 | 0.999 |
| GS1844 | N | n.d. | — | n.d. | — |
| GS1845 | N | 23 ± 6 | 0.287 | 24 ± 6 | 0.134 |
| GS1846 | N | 22 ± 5 | 0.871 | n.d. | — |
| GS1847 | N | n.d. | — | n.d. | — |
| GS1848 | N | 18 ± 8 | 0.995 | 7 ± 8 | 1.000 |
| GS1849 | N | n.d. | — | 5 ± 8 | 1.000 |
| GS1850 | N | 13 ± 6 | 0.999 | 0 ± 6 | 1.000 |
| GS1852 | N | 22 ± 4 | 0.876 | n.d. | — |
| GS1853 | N | 14 ± 6 | 0.996 | 0 ± 5 | 1.000 |
| GS1855 | N | 26 ± 4 | 0.524 | 10 ± 6 | 0.792 |

TABLE 2-continued

% decrease =/− SE

| ID | Active | TP1 | TP1 p-value | TP2 | TP2 p-value |
|---|---|---|---|---|---|
| GS1856 | N | 1 ± 7 | 1.000 | 6 ± 8 | 1.000 |
| GS1857 | N | 28 ± 5 | 0.537 | 14 ± 7 | 0.802 |
| GS1859 | N | 32 ± 5 | 0.241 | 26 ± 7 | 0.500 |
| GS1862 | N | 26 ± 4 | 0.617 | 29 ± 5 | 0.236 |
| GS1863 | N | 6 ± 5 | 1.000 | n.d. | — |
| GS1864 | N | 5 ± 6 | 0.999 | 3 ± 9 | 1.000 |
| GS1865 | N | 5 ± 6 | 0.998 | 3 ± 10 | 1.000 |
| GS1866 | N | 8 ± 5 | 0.955 | 13 ± 7 | 0.589 |
| GS1867 | N | 7 ± 4 | 0.994 | n.d. | — |
| GS1868 | N | 1 ± 6 | 1.000 | n.d. | — |
| GS1869 | N | 21 ± 7 | 0.395 | 17 ± 7 | 0.529 |
| GS1870 | N | 11 ± 5 | 0.825 | 13 ± 8 | 0.541 |
| GS1873 | N | 4 ± 4 | 1.000 | n.d. | 1.000 |
| GS1874 | N | 25 ± 4 | 0.359 | 14 ± 5 | 0.680 |
| GS1875 | Y | 55 ± 4 | 0.001 | 41 ± 5 | 0.010 |
| GS1876 | N | 20 ± 6 | 0.490 | 10 ± 8 | 0.819 |
| GS1879 | Y | 49 ± 5 | 0.002 | 41 ± 7 | 0.006 |
| GS1882 | N | n.d. | — | n.d. | — |
| GS1884 | N | 12 ± 4 | 1.000 | n.d. | — |
| GS1885 | Y | 67 ± 4 | <.0001 | 58 ± 5 | <.0001 |
| GS1886 | N | n.d. | — | n.d. | — |
| GS1887 | N | n.d. | — | n.d. | — |
| GS1888 | N | 19 ± 6 | 0.546 | 19 ± 6 | 0.281 |
| GS1889 | N | — | — | n.d. | — |
| GS1890 | N | 16 ± 5 | 0.684 | 4 ± 5 | 1.000 |
| GS1891 | N | 3 ± 7 | 0.993 | 4 ± 7 | 0.999 |
| GS1892 | N | 8 ± 5 | 0.995 | 3 ± 6 | 1.000 |
| GS1893 | N | 5 ± 5 | 0.990 | n.d. | — |
| GS1894 | N | 4 ± 6 | 0.990 | 0 ± 6 | 1.000 |
| GS1895 | N | n.d. | — | 4 ± 7 | 0.528 |
| GS2382 | N | 17 ± 0 | 0.743 | 4 ± 0 | 1.000 |
| GS2384 | N | 20 ± 0 | 0.468 | 8 ± 0 | 1.000 |
| GS2655 | N | 26 ± 9 | 0.979 | 9 ± 9 | 1.000 |
| GS2656 | N | 34 ± 5 | 0.447 | 46 ± 6 | 0.009 |
| GS2660 | N | n.d. | — | 24 ± 8 | 1.000 |
| GS2661 | N | 3 ± 3 | 1.000 | 14 ± 5 | 0.755 |
| GS2666 | N | 14 ± 7 | 0.990 | n.d. | — |
| GS2668 | Y | 46 ± 3 | 0.003 | 38 ± 4 | 0.051 |
| GS2674 | N | 17 ± 4 | 0.752 | 5 ± 6 | 0.999 |
| GS2679 | N | 25 ± 3 | 0.376 | 24 ± 5 | 0.413 |
| GS2680 | N | 12 ± 4 | 1.000 | 11 ± 5 | 0.997 |
| GS2684 | N | 31 ± 4 | 1.000 | 18 ± 4 | 1.000 |
| GS2685 | N | 23 ± 0 | 0.280 | 15 ± 0 | 0.949 |
| GS2686 | N | 18 ± 0 | 0.574 | 12 ± 0 | 1.000 |
| GS2690 | N | 21 ± 8 | 0.969 | 18 ± 8 | 0.863 |
| GS2691 | N | 8 ± 5 | 0.978 | 6 ± 7 | 0.996 |
| GS2732 | N | n.d. | — | 18 ± 10 | 0.899 |
| GS2736 | N | 10 ± 10 | 0.979 | 19 ± 10 | 0.942 |
| GS2788 | N | 26 ± 5 | 0.906 | 2 ± 8 | 1.000 |
| GS2799 | N | 31 ± 5 | 0.581 | 20 ± 8 | 0.919 |
| GS2804 | N | 32 ± 5 | 0.515 | 10 ± 8 | 1.000 |
| GS3295 | N | 33 ± 6 | 0.415 | 26 ± 8 | 0.851 |
| GS3297 | N | 12 ± 6 | 0.897 | 22 ± 7 | 0.199 |
| GS3298 | N | 22 ± 5 | 0.997 | 7 ± 7 | 1.000 |
| GS3299 | N | n.d. | — | 14 ± 7 | 0.997 |
| GS3300 | N | 9 ± 5 | 1.000 | 4 ± 8 | 1.000 |
| GS3301 | N | 32 ± 5 | 0.507 | 0 ± 9 | 1.000 |
| GS3302 | N | 31 ± 5 | 0.585 | 22 ± 7 | 0.962 |
| GS3303 | N | 35 ± 5 | 0.487 | 15 ± 9 | 0.928 |
| GS3304 | N | n.d. | — | 6 ± 7 | 1.000 |
| GS3305 | N | 4 ± 6 | 1.000 | n.d. | — |
| GS3306 | N | n.d. | — | n.d. | — |
| GS3310 | N | 22 ± 8 | 0.979 | 11 ± 8 | 1.000 |
| GS3311 | N | 29 ± 7 | 0.900 | 24 ± 7 | 1.000 |
| GS3312 | N | 13 ± 4 | 0.974 | 19 ± 6 | 0.458 |
| GS3313 | N | 9 ± 9 | 1.000 | 13 ± 9 | 1.000 |
| GS3314 | N | 17 ± 8 | 1.000 | 12 ± 8 | 1.000 |
| GS3317 | N | 21 ± 9 | 0.999 | 17 ± 9 | 1.000 |
| GS3319 | N | 23 ± 8 | 1.000 | 25 ± 7 | 1.000 |
| GS3320 | N | 20 ± 8 | 0.999 | 5 ± 8 | 1.000 |
| GS3321 | N | n.d. | — | n.d. | — |
| GS3322 | N | 27 ± 8 | 0.961 | 18 ± 8 | 1.000 |
| GS3323 | N | 26 ± 7 | 0.996 | 19 ± 7 | 1.000 |
| GS3324 | N | 12 ± 7 | 1.000 | 14 ± 7 | 1.000 |
| GS3325 | N | n.d. | — | n.d. | 0.154 |
| GS3326 | N | n.d. | — | n.d. | 0.504 |
| GS3328 | N | 10 ± 6 | 0.993 | n.d. | — |
| GS3331 | N | n.d. | — | n.d. | — |
| GS3333 | N | 5 ± 6 | 1.000 | n.d. | — |
| GS3334 | N | n.d. | — | n.d. | — |
| GS3335 | N | 12 ± 6 | 1.000 | n.d. | — |
| GS3336 | Y | 72 ± 2 | <.0001 | 57 ± 4 | <.0001 |
| GS3337 | N | 19 ± 5 | 0.655 | 15 ± 7 | 0.820 |
| GS3339 | N | n.d. | — | n.d. | — |
| GS3340 | N | n.d. | — | n.d. | — |
| GS3341 | N | n.d. | — | n.d. | — |
| GS3343 | N | 7 ± 6 | 1.000 | n.d. | — |
| GS3344 | N | 1 ± 7 | 1.000 | n.d. | — |
| GS3345 | N | n.d. | — | n.d. | — |
| GS3346 | N | 3 ± 6 | 1.000 | n.d. | — |
| GS3347 | N | 2 ± 7 | 1.000 | n.d. | — |
| GS3351 | N | 4 ± 7 | 1.000 | n.d. | 0.372 |
| GS3352 | N | 6 ± 4 | 0.999 | n.d. | 1.000 |
| GS3353 | N | n.d. | — | n.d. | — |
| GS3354 | N | n.d. | — | n.d. | — |
| GS3355 | N | n.d. | — | n.d. | — |
| GS3356 | N | 5 ± 5 | 0.956 | n.d. | — |
| GS3357 | N | 9 ± 6 | 0.735 | 7 ± 6 | 0.997 |
| GS3358 | N | 6 ± 4 | 0.989 | n.d. | 0.077 |
| GS3359 | N | 14 ± 4 | 0.919 | n.d. | — |
| GS3360 | N | 36 ± 4 | 0.061 | 30 ± 5 | 0.034 |
| GS3361 | N | 16 ± 3 | 0.686 | n.d. | — |
| GS3362 | N | 14 ± 4 | 0.944 | n.d. | — |
| GS3445 | N | 14 ± 9 | 0.991 | 16 ± 10 | 0.940 |
| GS3446 | N | 36 ± 3 | 0.089 | n.d. | — |
| GS3447 | N | 35 ± 3 | 0.188 | n.d. | — |
| GS3448 | N | 19 ± 3 | 0.610 | n.d. | — |
| GS3449 | N | 18 ± 4 | 0.632 | n.d. | — |
| GS3450 | N | n.d. | — | n.d. | — |
| GS3451 | N | n.d. | — | n.d. | — |
| GS3452 | N | n.d. | — | n.d. | — |
| GS3453 | N | n.d. | — | n.d. | — |
| GS3454 | N | 4 ± 4 | 1.000 | 0 ± 9 | 1.000 |
| GS3455 | N | n.d. | — | n.d. | — |
| GS3456 | N | n.d. | — | n.d. | — |
| GS3457 | N | 13 ± 4 | 0.983 | n.d. | — |
| GS3458 | N | n.d. | — | n.d. | — |
| GS3459 | N | 25 ± 5 | 0.959 | n.d. | — |
| GS3460 | N | n.d. | — | n.d. | — |
| GS3461 | N | n.d. | — | n.d. | — |
| GS3462 | N | n.d. | — | n.d. | — |
| GS3463 | N | n.d. | — | n.d. | — |
| GS3464 | N | n.d. | — | n.d. | — |
| GS3465 | N | n.d. | — | n.d. | — |
| GS3466 | N | 21 ± 7 | 0.918 | 19 ± 11 | 0.982 |
| GS3467 | N | 25 ± 4 | 0.951 | 13 ± 7 | 0.998 |
| GS3468 | N | n.d. | — | n.d. | — |
| GS3469 | N | n.d. | — | n.d. | — |
| GS3470 | N | n.d. | — | n.d. | — |
| GS3471 | N | n.d. | — | n.d. | — |
| GS3472 | N | 28 ± 5 | 0.941 | 22 ± 6 | 0.819 |
| GS3473 | N | n.d. | — | n.d. | — |
| GS3474 | N | 17 ± 5 | 1.000 | 9 ± 8 | 1.000 |
| GS3475 | N | n.d. | — | n.d. | — |
| GS3476 | N | n.d. | — | n.d. | — |
| GS3477 | N | 28 ± 4 | 0.922 | 7 ± 8 | 1.000 |
| GS3478 | N | 29 ± 4 | 0.837 | 13 ± 9 | 0.996 |
| GS3479 | N | n.d. | — | n.d. | — |
| GS3523 | N | 8 ± 11 | 1.000 | 12 ± 10 | 0.998 |
| GS3524 | N | 3 ± 11 | 0.771 | 22 ± 12 | 0.635 |
| GS3525 | N | 17 ± 9 | 0.470 | 34 ± 8 | 0.131 |
| GS3526 | N | 22 ± 10 | 1.000 | 11 ± 10 | 1.000 |
| GS3600 | N | n.d. | — | n.d. | — |
| GS3601 | N | n.d. | — | 2 ± 3 | 1.000 |
| GS3602 | N | 5 ± 6 | 1.000 | 7 ± 8 | 1.000 |
| GS3603 | N | n.d. | — | 7 ± 5 | 1.000 |
| GS3605 | N | n.d. | — | n.d. | 1.000 |
| GS3606 | N | 3 ± 6 | 1.000 | 9 ± 7 | 0.999 |
| GS3609 | N | 13 ± 8 | 0.971 | 9 ± 6 | 0.999 |
| GS3610 | N | 10 ± 6 | 0.987 | 5 ± 6 | 1.000 |

TABLE 2-continued

| | | | % decrease =/− SE | | |
|---|---|---|---|---|---|
| ID | Active | TP1 | TP1 p-value | TP2 | TP2 p-value |
| GS3612 | N | 22 ± 6 | 0.363 | n.d. | — |
| GS3613 | N | 11 ± 3 | 0.973 | n.d. | — |
| GS3614 | N | n.d. | — | n.d. | 1.000 |
| GS3615 | N | 4 ± 5 | 1.000 | 5 ± 5 | 1.000 |
| GS3616 | N | 14 ± 4 | 0.864 | n.d. | — |
| GS3617 | N | 22 ± 6 | 0.364 | 14 ± 6 | 0.781 |
| GS3618 | N | 27 ± 4 | 0.130 | n.d. | — |
| GS3619 | N | 9 ± 2 | 0.997 | n.d. | — |
| GS3620 | N | 6 ± 8 | 1.000 | 8 ± 7 | 0.999 |
| GS3622 | N | 17 ± 4 | 0.626 | n.d. | — |
| GS3623 | N | 20 ± 3 | 0.487 | n.d. | — |
| GS3625 | N | 1 ± 2 | 1.000 | 0 ± 3 | 1.000 |
| GS3626 | N | 3 ± 7 | 1.000 | 26 ± 7 | 0.274 |
| GS3627 | N | 30 ± 3 | 0.117 | 29 ± 6 | 0.000 |
| GS3628 | N | 12 ± 2 | 1.000 | 7 ± 5 | 0.947 |
| GS3672 | N | 34 ± 4 | 0.070 | 26 ± 7 | 0.109 |
| GS3673 | N | 34 ± 4 | 0.049 | 29 ± 6 | 0.031 |
| GS3674 | N | n.d. | — | 8 ± 5 | 1.000 |
| GS3915 | N | 2 ± 10 | 0.983 | 27 ± 10 | 0.425 |
| GS3916 | N | 11 ± 9 | 0.964 | n.d. | — |
| GS3917 | N | n.d. | — | 29 ± 12 | 0.349 |
| GS3919 | N | 23 ± 8 | 1.000 | 16 ± 9 | 1.000 |
| GS3920 | N | 14 ± 11 | 1.000 | 12 ± 12 | 1.000 |
| GS3921 | N | 3 ± 8 | 1.000 | 8 ± 8 | 1.000 |
| GS3922 | N | n.d. | — | 27 ± 12 | 0.345 |
| GS3923 | N | 19 ± 10 | 1.000 | 2 ± 10 | 1.000 |
| GS3924 | N | n.d. | — | n.d. | — |
| GS3925 | N | 18 ± 4 | 0.932 | 3 ± 6 | 1.000 |
| GS3926 | N | n.d. | — | n.d. | — |
| GS3927 | N | 7 ± 3 | 1.000 | n.d. | — |
| GS3928 | N | 15 ± 6 | 0.955 | 9 ± 7 | 0.999 |
| GS3929 | N | n.d. | — | 19 ± 7 | 0.451 |
| GS3930 | N | 10 ± 4 | 1.000 | n.d. | — |
| GS3931 | N | 14 ± 4 | 0.994 | n.d. | — |
| GS3932 | N | n.d. | — | n.d. | — |
| GS3934 | N | 31 ± 5 | 0.248 | 17 ± 6 | 0.478 |
| GS3935 | N | 1 ± 5 | 1.000 | n.d. | — |
| GS3936 | N | n.d. | — | n.d. | — |
| GS3937 | N | 12 ± 5 | 0.999 | n.d. | — |
| GS3938 | N | 3 ± 5 | 1.000 | n.d. | — |
| GS3939 | N | 4 ± 5 | 1.000 | n.d. | — |

Example 3

Figure 3:
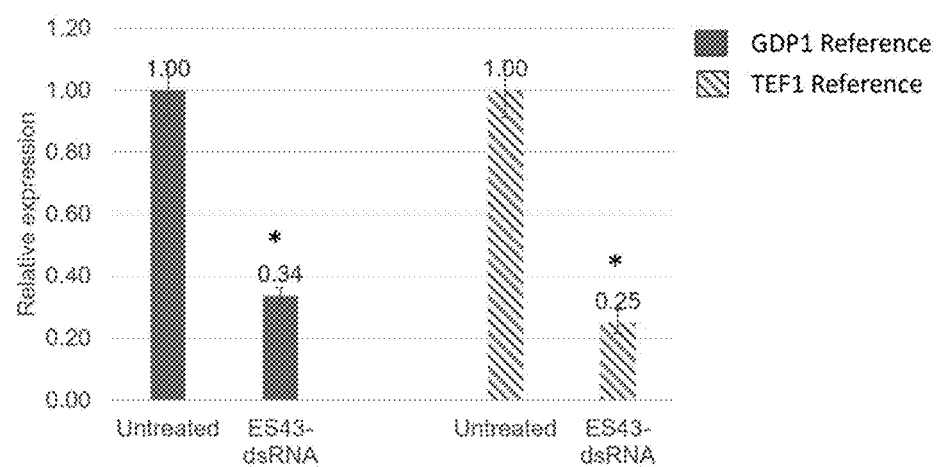
FIG. 3. Gene specific qRT-PCR analysis of ES43 (Cyp51) transcripts at 6-dpi in leaf discs. Two housekeeping genes (GDP1 and TEF1) were used as endogenous references to examine the expression of Cyp51. Gene expression was normalized to the untreated control. Statistical significance at p<0.01, Mann-Whitney U test.
Figure 4:
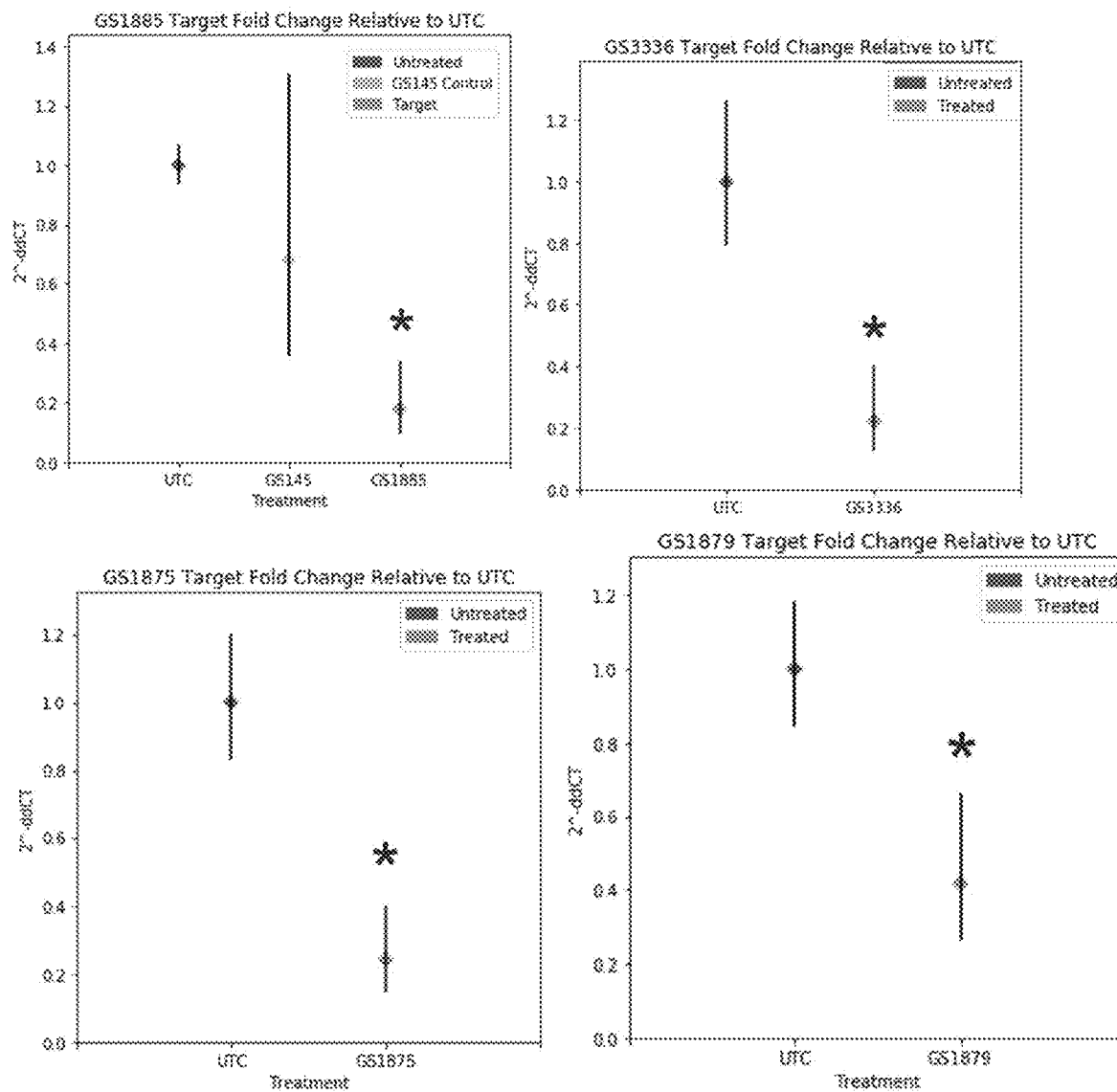
FIG. 4. Gene specific qRT-PCR analysis of GS1885, GS3336, GS1875, GS1879 transcripts at 6-dpi in leaf discs. The 2-ΔΔCT method was used to analyze the relative changes in gene expression. Gene expression was normalized to the untreated control. GS145 (a non-target dsRNA sequence) was also included as control. Asterisks denote significant differences compared to untreated control (UTC). Statistical comparisons between treatments were performed with ANOVA, followed by Welch's analysis.

Sprayed dsRNA-ES43-GS1885, -GS3336, -GS1875, -GS1879 Induced Gene Silencing in *E. necator* qRT-PCR was performed to validate the effect of exogenous dsRNA on the expression of selected targeted genes for which activity of dsRNA had been shown by leaf assay (as described in Example 2). Samples were treated with dsRNA, inoculated after 24 hours and six leaf discs per treatment were collected at six-days post inoculation (dpi) for further analysis. Results of gene expression analysis are shown in FIG. 3 and FIG. 4, demonstrating significant reduction in gene expression of targets vs. untreated controls. As shown in FIG. 3, relative amounts of ES43 (Cyp51) transcripts were reduced up to 70% compared to untreated control, demonstrating silencing of Cyp51.

As shown in FIG. 4, gene expresssion levels were significantly lowe than untreated controll, demonstrating gene silencing for the relevant gene targets.

Example 4

Sprayed ES43-dsRNA Controls Cyp51 *E. necator* as Demonstrated in Greenhouse Testing A greenhouse trial was performed to evaluate the efficacy of ES43 dsRNA for controlling *E. necator* in grapes compared with commercial fungicides (Luna Experience/Pristina) and biofungicides (Regalia Biofungicide/Double Nickel). Treatments, rates, and application intervals for the trial are shown in Table 4

TABLE 4

| Treatment | Rate | Application interval |
|---|---|---|
| Untreated control | | |
| ES43 | 6.25 g ai/ha | 7-day (once/week) |
| ES43 | 25 g ai/ha | 7-day (once/week) |
| ES43 | 50 g ai/ha | 7-day (once/week) |
| ES43 | 100 g ai/ha | 7-day (once/week) |
| ES43 | 25 g ai/ha | 3/4-day (twice/week) |
| ES43 | 100 g ai/ha | 3/4-day (twice/week) |
| Luna Experience/ Pristine | 252 g ai/ha/ 333 g ai/ha | 7-day (once/week) |
| Regalia Biofungicide/ Double Nickel 55 | 470 g ai/ha/ 1.68E13 CFU/ha | 7-day (once/week) |

Disease incidence was calculated based on the total number of leaves on the plant infected with powdery mildew, out of number of leaves present. Disease severity was calculated based on the percent (%) leaf surface infected overall for each plant. Area under the disease progress curve (AUDPC) was then calculated throughout the entire trial period (FIGS. 5 and 6).

Figure 5:
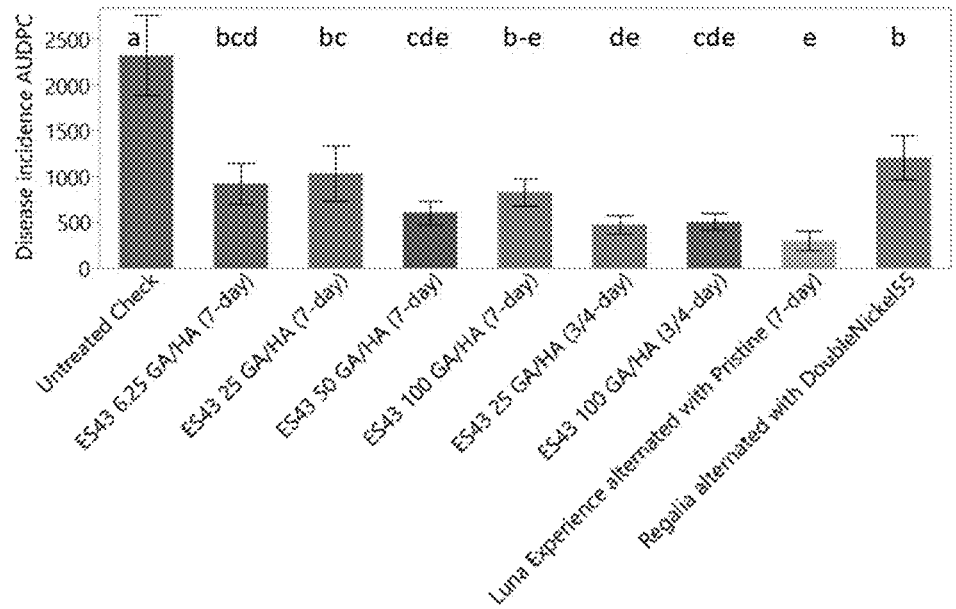
FIG. 5. Area under the disease progress curve (AUDPC) based on disease incidence throughout the entire trial period. Bars are means±SE, treatments with different letters are statistically different based on Fisher's LSD test at alpha=0.05
Figure 6:
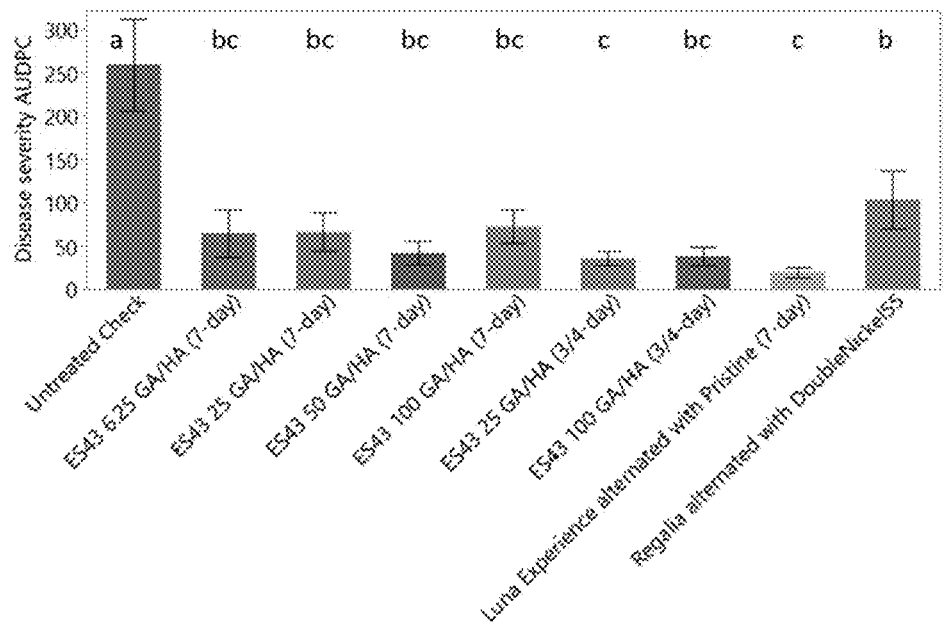
FIG. 6. Area under the disease progress curve (AUDPC) based on disease severity. Bars are means±SE, treatments with different letters are statistically different based on Fisher's LSD test at alpha=0.05

As shown in FIG. 5, ES43 on a weekly spray interval reduced powdery mildew AUDPC incidence with all rates similar to or better than the biofungicide standard (Regalia/Double Nickel) and 50-100 g of ES43 similar to the traditional standard program (Luna Experience/Pristine). Numerically, twice per week applications provided greater reduction in disease incidence compared to once per week applications at the same rate. As shown in FIG. 6, ES43 and standards significantly decreased severity vs. untreated control. ES43 on a weekly and twice-per-week spray interval performed similarly to commercial fungicide and biofungicides evaluated here.

Example 5

Sprayed ES43-dsRNA Controls Cyp51 *E. necator* as Demonstrated in Field Testing

A field trial was conducted in ACDS Research vineyard (Dundee, New York) with natural disease infestation on grapes. The trial was set up in four rows (180 ft$^2$) of Chardonnay grapes, with plots consisting of four vines. The trial included 11 treatments (Table 5), each replicated four times. The grower spray program from budbreak through pre-bloom consisted of sulfur, and trial applications were initiated at bloom. Eight to fifteen applications of ES43 (6.25, 25, 50 and 100 g Ai/ha) were compared with Regalia (470 g Ai/ha) and DoubleNickel (10 billion Cfu/ml), Pristine (333 g Ai/ha) Rally 40 WSP (140 g Ai/ha) and Luna Experience (250 g Ai/ha). Disease incidence, total number of leaves infected out of number of leaves present on several branches, Weekly assessments was performed 1 day before ES43 applications. Data was collected one week after the last application for all treatments at the close of the experiment.

Figure 7:
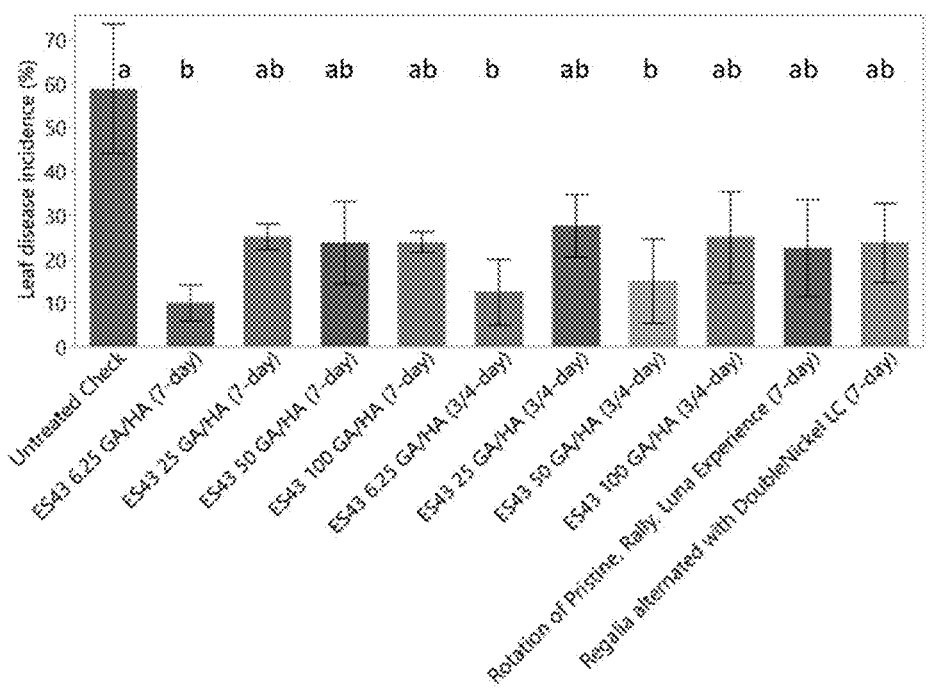
FIG. 7. Leaf disease incidence at 57 days after initial treatments.

Disease incidence was calculated based on number of leaves infected with powdery mildew out of 20 total leaves. As shown in FIG. 7, ES43 showed significantly decreased disease incidence at 6.25 g Ai/ha dose at both 7-day and when applied twice a week (3/4-day). ES43 at 50 g Ai/ha also decreased incidence compared to untreated control.

TABLE 5

| Treatments | | |
|---|---|---|
| Treatment | Rate | Application interval |
| Untreated control | | |
| ES43 | 6.25 g ai/ha | 7-day (once/weekly) |
| ES43 | 25 g ai/ha | 7-day (once/weekly) |
| ES43 | 50 g ai/ha | 7-day (once/weekly) |
| ES43 | 100 g ai/ha | 7-day (once/weekly) |
| ES43 | 6.25 g ai/ha | 3/4-day (twice/week) |
| ES43 | 25 g ai/ha | 3/4-day (twice/week) |
| ES43 | 50 g ai/ha | 3/4-day (twice/week) |
| ES43 | 100 g ai/ha | 3/4-day (twice/week) |
| Pristine/Rally/ Luna Experience | 333 g ai/ha/ 140 g ai/ha/ 250 g ai/ha | 7-day (once/weekly) |
| Regalia Biofungicide/ Double Nickei 55 | 470 g ai/ha/ 1.4E14 CFU/ha | 7-day (once/weekly) |

REFERENCES

Sambucci O., Alston J M., Fuller K B., Lusk J. The Pecuniary and Non-Pecuniary Costs of Powdery Mildew and the Potential Value of Resistant Varieties in California Grapes. *Am J Enol Vitic.* 2019. doi: 10.5344/ajev.2018.18032

Vielba-Fernández A., Polonio Á., Ruiz-Jiménez L., de Vicente A., Pérez-García A., Fernández-Ortuño D. Fungicide Resistance in Powdery Mildew Fungi. *Microorganisms* 2020, 8:1431. doi.org/10.3390/microorganisms8091431

Cagliari, D., Dias N P., Galdeano D M., Dos Santos E A., Smagghe G., Zotti M J. (2019). Management of Pest Insects and Plant Diseases by Non-Transformative RNAi. Front Plant Sci. 2019 10:1319. doi: 10.3389/fpls.2019.01319.

SEQUENCE LISTING (1284 sequences)

SEQ ID NO: 1 - DNA, 1756 bp, Artificial Sequence
  Synthetic
  misc_feature (495)..(495): n is a, c, g, or t
  misc_feature (608)..(608): n is a, c, g, or t
  misc_feature (1119)..(1119): n is a, c, g, or t
  misc_feature (1170)..(1170): n is a, c, g, or t
  misc_feature (1620)..(1620): n is a, c, g, or t
taaggtagtattgaggcgggtaaatcggccattatgtacattgctgacattttgtcggatctactgactcaacagacgacacgatatgggtggattttcatggtcacaagtatcgcattttctataatactattggccgttgggttaaatgtattgagccagttgctgttccgtagaccctacgagccaccagttgtatttcattggtttccaataattggaagtacaatttcgtatggaattgatccatataaattttattttgattgtagagccaaagtaagtagagctcttttacatgcccatctccagatcattaacaaccatcttttagtatggagacatttttacatttattctcctcgggaaaaaagtaacagtctatctgggacttcaaggtaataattttatacttaatgggaagttaaaagatgtcaacgccgaagagatttacactaatttaacaactccggtctttggaagagatgttgtatntgattgtccaaattccaaactcatggaacaaaaaaaggtccgtaaatggtcgagtagtaatttttgagattcgatctgaactgctggtagtttatgaaaacggctcttaccantgaagcgttccattcctatgtaacaataatacaaaatgaagtagaggcatatataaacaattgcgttagctttcagggtgagagtggcacagtaaacatctcaaaagttatggcggaaatcactatatatactgcttcacatgccttacaaggagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctaggacttatatgaatataatccaagctcgtagagaagagaaaagaagcggtgagaataagcatgatataatgtgggagttgatgcgttccacttataaagacgggactccggtacctgatcgagagatagcgcatatgatgatagcccttctgatggctggacaacactcttcgtcatccacgagctcatggattatgctttggttagccgcncgaccagatatcatggaagagttgtatgaggaacaacttcggatttttggntcagaaaagcccttcccgcctttacaatatgaagatctttcaaaacttcaacttcatcaaaatgttttgaaagaagttctgcgacttcacgctcccatacactcaatcatgcggaaggtcaagaatccaatgatcgtgccaggcactaaatacgtcattccgacgtcgcatgtactcatctcatcgcccggatgtactagtcaggatgccactttttttccagaccctctcaaatgggatcctcatcgatgggacattggatcaggtaaagtcctaggaaatgatgcggttgatgagaagtatgattatgggtatggtttaactagcacaggagcgtcaagtccatatctaccttttggtgcgggtcggcatcgatgtattggcgagcaatttgccacattgcagctagtgacaataatggcaactatggtgcgtttttttaggttccgnaatatagatgggaagcagggggttgtaaagacagactattcaagtctattttcgatgcctctcgcaccagccctgataggctgggaaaagagatgactgttatcgtaattatttatggcaggtgttagggttagaa

SEQ ID NO: 2 - DNA, 457 bp, Artificial Sequence
  Synthetic
  misc_feature (304)..(304): n is a, c, g, or t
ctcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacagttgaaaaagacaatatttcgaagttcccgagagctttcgtatccggcaatgactgcatcacgtcgaatttctacgatccaagacgaaaatagtttgtttttttngctgttggcgtggagtctagctgttgtgtacccgaaccctattcggatcatcaaataggattgtaagttggttcatcattttatgaacagattcaaattgtattaccccattcttaatcaataccatgcaggtgtgactgacagtccttatca

SEQ ID NO: 3 - DNA, 1283 bp, Artificial Sequence
  Synthetic
  misc_feature (1275)..(1277): n is a, c, g, or t
ttggaagaaccgccagaaaacccaatcagataccgatctctactcggatcatcatttcacttcgcaacatgcaattaacggttatgtaccttctataggctttgaatccgatggttatgggattagtaagagatctaatcgtaaaactgttcatggatattactgtgggagctcaaaacatgagcagcatttttatgagcaggactatattaaaatatatacatgtcaaacataatgcaaacttaattccatatagttaactgaaatggtcattttttcacagctttaactcaattccttttgaagagtgataacttttacttgcaattcctaattaaaataagagcacaagccttaatttttggatctaaaatatcaatgccaaccccttgtgcactgttggtagtgaaaatcttcgttatttgtgacaacatccacaatctcgcactgcgtattgataacaactcgatttgggtacttgttcttcttcttctttgcaaataatttcttcttatgcttcccgcgtattggatattcaaagtatggaccctgaaaactctggtaagatgtggctgtaaagggtttgaggtttttgcgtttttttctgaacctaaacctaattcgttacatgcctgagtcgcagcattgttaatatagtcctgctcataaaaatgctgctcatgttttgagctcccacagtaatatccatgaacagttttacgattagatctcttactaatcccataaccatcggattcaaagcctatagaaggtacataaccgttaattgcatgttgcgaaagtgaaatgatgatccgagtagagatcggtatctgattgggttttctggcggttcttccaacgtgggaggtcagaatcaagcgttgtggaaacagatgacaaaagcagagttatcgttattccagtaacaaaataacgcatagttagaaacttcctattattagccaacagggtttacagctggtatttctagaaaagtccaaaagattggttatggagctgcctcttaagtaaaaaatgaaacaggaagagacccaaaagccgaggatgacccattgtaaagagctatttggccttttgtcagctacaaaatcgaatacccgcacttcctgggcatgattttgagttcgagccgtcatatcataagtggcaaaattgaatagcaaattttgaatccataacagcgccaatgatacagttctccttcagaaattagcctcctatgtggacacacacacattgcaaaatattttnnnaaaacc

SEQ ID NO: 4 - DNA, 585 bp, Artificial Sequence
  Synthetic
atgcgtttcttcatcgaggccatcgtctctactttgattttgtccccaatttctgtcctttctatggagactggtaatgatgctaccgaagtagcagcggacatcgccgacggccctacactgtcagggctacctggggttgcagatttcgacttgtcttcagcgtcctccccaagtctcgagaaaagactttgttttagacgaggatgcaataaaaaatctaaacacgcatcaggcttccaatgtaagaagaaacatttcagtctggcggcggtagaaaaagcaaaagccgtagcctgcgcaaagatcaaagaaaacaagcagcgcaatgcctttcctgctctttacaccgcaaccgatttcgaaactcccgggccttatctagaatggccaatcaagcgcaatggaagattttggaataatttgagaagaggccgttaccgcatcatcctaaccgaaaactgcaaagttgtcggtgctgtgatccggaaaagcaatggttcataccgcacatgcaagaaactgagcgaaaaagatgaagatgaagttgatgatgatgatgaaaaagaagaatccgatgattga

SEQ ID NO: 5 - DNA, 555 bp, Artificial Sequence
  Synthetic
atgcgtttcatcataggagctgtcgtctcttcactcattttgtcgccaatttcagtgctttctatggcggctagtaatgactctaccgaagctgcagcgcatatcataaatgattctatactagaagatgtttcgaacgttgcagatttcgactggtcttcaacgtcatatcaaggcctagagaaaagattttgtttcagacgaggatgcaaggaagaaaagctcaagaggacatcaggtttccaatgcaaaaagaagtacatcagctcggagaaaattgagagagcaaaagccgctggctgtccggaaatcaaaaaaaataagcagcgatccgcttttccttctctctacactgcatccgactttgctgttccaggtccttacctagaatggccgatcagccgcaatggaaggttttggaacaaattgagtaagggcaagtaccgtatcatcatgaccaaaagctgcaaggtggttggtgttgtgattcgggagaagaaaagctcataccgcacatgcaaagacttgagcaaagaagaagatgaagatgaataa

SEQ ID NO: 6 - DNA, 747 bp, Artificial Sequence
  Synthetic
atgttcaaaaaatttattttcctctcaagccaggccttaatggtactttcgaatcctctttatattggtgataatcatcttccgagcgaccaaaataatccgttcttaatatcctatgattggaaagctggctttacaagcgaattcgaacttcatgattcctgcaatgcaacacagaaaaaacagctgcaagacggcctctctgacgctgtgacacttgctaggcatgctaaagaacatattcttgtgaagggaactgaatcacccatatataagaaatatttcggtcaaggtcctacaggatcggtcctgggatggtatgacaaaattgcttcttctgaccgaaaagacatccttttccgttgtgatgaccccgataagaattgccaaactcaacctcaatgggctggacatcaccgcggaaaaaatgcgtcattagagacagtgatctgcgagctttcatttctcactcggcttccacttgaagctctttgctcaccaggtatggataaggttaccggtaaacctaataaattatggggacctgatttgatacatcgactttaccacttaaacaaaattggcgaaggagttattaagcactatacacatggcaaatctgaagctcttgagttggcatctagtgaaaactactctcttgcggcgacaaatacagattcattgctcctcttcgcaaatgaggcttacgctttcgacataataaatccaggagttggctgtctttaa

SEQ ID NO: 7 - DNA, 790 bp, Artificial Sequence
  Synthetic
acgattatcgccaattggggtgatactgttgtagtacatgttactaattcattaatgaataatggaacgagcattcattttcatggactccggcaattcgaaacaaaccaaatggatggtccaacatcaataacacagtgtcccatagctcccggtgatagttttacatatagatgggttgcctctcagtacggaagttcatggtaccatgctcatttcgccgtactttcgaattgccggagtccatgaaaatgaatgctcgttccattattcattaatgaattagtaacatgtactacaacagtatcaccccaattggcgataatcgtaggccctggaaccattccattcacactcaatactattctttctacttcatctaaagccattgtcttattttcaacattaaaccagtactcgcggactacacctgtgtctggtgactcttcatagtaatttgttgaaagactgtattttccccaacaagcgcggtcatcgggaccatgagaacatattccctgaggataccgtggtgttgcattagctccaaaggaagcccaaatggcgataagtaacatagaaagaaaagaaagaaacataacgaatgtttatgaatttgatgagagactgagagaattagagaattgattctcggtggcttttgaatcttacaccaagaagagacttatataaatccccagaatatttgtttccatagtatcttagcaattaaaaaaacattcccatactccacgcgactcatggaatccgcagttcaatgcaccagcgg

SEQ ID NO: 8 - DNA, 614 bp, Artificial Sequence
  Synthetic
ctgaattgttttgagactgtttattacgaaacccattacttttgtctttgatatggaatctccgattgacaaacaatgtttcgtcaggttttggttcatagctagtggtcattccaatggcacctctaatgttattaataacagtattgagtgattgctcaggcattaaacaagctgggcgacattcgggtatatttgaaacagattgtaaaattttgtcacgaagggttgtttcgtcttgaaaatttggtcgcaagcataactggagattacgaagttgttttactaatatttcaaatacatcaagcaatggcttttcagaatgttgactagaaagaagttgcaaggtaattttgttccattcattctgtgcatttctctgtttttgtggtccttcaaattggccaagcattaattgagagatttcatcgatctgtattgcattgctacagcgatgatggtagaagtctaatgcttctttgttaaacattaagaacatagaagacaggatgtctttttcattttcgatgctcgctaattcgcattttttcaaaaagatgtttaacttgaagttatagctatcatcttttccaccactatacttttcgctttcg

SEQ ID NO: 9 - DNA, 1187 bp, Artificial Sequence
  Synthetic
aactttagagacgacaacctttgggaagcttaccaagatgagttttcagatttctctatcaatgactttaaagtagcctccaactcaatcctccgatctcttagaatcttcttacgatcacgtggagtttgggttaaatgggaacgcaatactacactagttacttctctatacaacacactcaaggagacttcgcctaccgaatggacaagtgaggaggttaataactccaatgaagtcttcgattctgtaaaaatcttccatatcgccaaaacacaaaaagcttcgctcaaagctgcttcaaaactccctgctcaacaagcccaaactacatcaaacacacaacctactataagccaggaaaatgaatctagcaaccgtaagacccatcaatcttatggatacggcaaggaattatccatcctatcaaaattatacgataacgatcttaaatatcacggagacaatgataattttgattttaaattaagtatcttctttgaactttgtgacaaagccgaaatccctgaacaagtatacggcaaagcattttcaactatgcttagtggcgccgctttacagcattattacaccacatcttcaaatagtttccggcgtgactttgagacattagttaatgctacaagagatcattttgaggggcctgaaatcagacgtagaagaactgctagatgggagtcacccactttacaaaagataatcgatgaaaaccaaggaaaagaaaagtccatggacgattgttttacactattattgaatgaactaagataccttcaacttagtctagataaagagttccgaacagaaaaagtccttcatacaaaactaatcaactcctgccgcaatatatctgcatgtcaactagcatgtttcaaacctagcaatacattgacaggcctcattagcgaccttcaatcgtcaattgctattagcgatgagaatatcaaagatcaatcatcacaattctttacagatagaaaataccacattaactctcaaagtatcaatcaaaacaaacacaagtctaattaccagtctacatcaaaacgaagatgttatgtgtgcgaaaaaccaaattgccattcaaaataccactcaaaatcagagcaagacgaggctcgaaagaaattcaaaagacgttttgtcaaacgtttcgataacatgac

SEQ ID NO: 10 - DNA, 611 bp, Artificial Sequence
  Synthetic
tcaatcattcaatacttatagacataatgtatattgataataatctagtgttgcatatcattgatgaagcaactaattttcaggcggctaggtggctcaataatatctctgccaaacatacatgggatgccatacgtgcttgttggattgatacttacgttgggcccccagactgcataataacagatgctggtaaaaacttcgttagcaaggaatttaatcaaaatgcatcatcaatggaaatttcggtgaaaaacgttcctgttgaagcgcattggtcaataggaaaaatagagcgctatcactcttgcattcgtcgagcttataaaattatatcagaagaactagctggaaccggaatcggcaaagagtttatgctccagatggcggtaaaagccataaacgacacagccggacctaatggcttagtcccaactcttttagtttttggagcttatccaagaatgtcaaatttagaccctcctatgccatccataattcaacgggctgctgcaatcaaaaaggcgatgctagagataagtaaattacgcgcaaagctaaccgtgaatagtgctctaaaccatcgaaacggaccgaatacgaatacccaa

SEQ ID NO: 11 - DNA, 832 bp, Artificial Sequence
  Synthetic
tacaatcccctttgatccagcatatatgagtaatttcacgtctctcatatgattggcggaggcacatcaaatctatcattaatcttttttctctggtggttccgagcttcaccaagcattcatatagtgatttagagtctgtacaaacaatgagaggtattcgcatactaaatattttctcaagtgtcgattttatggttgctccagagtcaaaaccgtgcaccattgcataaagttcagcagcgaggacgcttctagttattcttttgcatttaattgaggaccaatggagaatatttgctcgattctcctcgtctgctagtacaattacaaaaccaatttgagatgagaagtctttgttatttgcgaaggatgaatctgcaaaaactattactcttaatgagtttttattgagtttaacgaatttcaatcctctagaagcgttctcaatttgccagttaattcttttattaagtaatttgatatctgcttcgtttggattgacattttgggcagcagaggaaagatcgaaggaagcttcaggctgacataagcttgcaatatatgctgctcgggctctttgagcaacatattgttctttagttgttagtgacttcctgatcttgtttctaggactagttgtatcgactagtttgggaacaattgggctcaagtttttgcaatattgtgtctgtgttaaggtaatagaattgtcactttcaagttgaatttttcctccgttgaatttgagtagcgtctcagttgtgagcatttccctttcctttgcgatgaaacctgcttttgttaactctgtttgttcttttgtagtaaa

SEQ ID NO: 12 - skipped

SEQ ID NO: 13 - DNA, 502 bp, Artificial Sequence
  Synthetic
tttcgcaagcgggtgctctagagcagccacgtgtagcatgaaacccatgacaacgtttgcattgttgtattggttggcatggtttgtacagtatagcgactcctgattcgtcgaatagtcggaatccgggtcatggagcttgttctcgggaaaaatgtgccagccaagagcgatgtggagcaccagaacgagtcttaccatgtaccctaaccatcttaggcgcaaagttagtgactttgataatttcggctacaaggttagtatcgtcgactgtcacacttccactagaagtttgacgggcaacgggaacagttgcaatacgatatgtaataagatcagacgccggttctagcttggcaccctgaaaagatattctatcactgtcatttagtagcttttgccttatctccttttctttgatagtaagtgcgaagccagtgggggttcgagcgatgagcgtcacatcagatggtacacaatttagatttttgcacaatatttc

SEQ ID NO: 14 - DNA, 631 bp, Artificial Sequence
  Synthetic
gttgtagcatgtatttcggttatctacttgttttttattgcttttcaatgtcgacctgcaaactacctttggcaacaacttgattcaaaattatattctggaagctgtttgagcaaggagagtatagccgatattatatatgctcatgcatctataagttgtttaattgactggatctttgggatattaccgattttaattctctggaaactcgacatgaagttcaagaccaagctctctataatgatcgttctttcattaagtatagtagcctctatagctactgttatacgtattatttacctccatattcttaagaatgtgtcacaatccggttgggatggttttggattaataaaatggtctttactagaaccagccattgccttgacagctgcaaatattgcaactctcaggccacttacgcaaaagttattttcaaaaaaacgacgaccatctaaatcacaaccacctaagctttctctcaatgctattcggggcttaagtcggaagtcttcagtatgttgttcaagtgaatttgcagatatgttagggctagcagtatcacctggcgtgaaaactcgagtctatgctgatagaagacttgataacactatccaaaaaagacctt

SEQ ID NO: 15 - DNA, 412 bp, Artificial Sequence
  Synthetic
cggccaccaactgggtgtcagtactaataccaacagttccagctgttttacataaagaacaaggagtagttgaagtgagcaacagcatgcttgctgatgaggtggaacgtgtctgctctgtgcggccagctcacataaagctttatggaagaaataaacctgaggcaccgtatcgaacatggatggctttcttcccgaaagctccacgcggcacttttaaagtgttcgacgaatctggaattgcgagcgaggtcttttaaaaagcagcaacctctcgaattttgtaaaagatgcaatgggcaccactctattaaaaattgctcaagggctccttcgtgcggaaattgtggctcgaccaatcataccgaggatttatgtatggccgcaactaagtgtagaaattgtgggggcc

SEQ ID NO: 16 - DNA, 429 bp, Artificial Sequence
  Synthetic
atactaagccgactaaaggtagtggctctgggtctggaaaagggaaaaatgtagaaaagaatgttgctgttgcaacccctaaattaccaaaacctccccaaacctcactgaacacatgggttactgtggctcgaaatggtcagaagaaggcccgagttcttcaaaataataatatacacaccaccccgatgagtaaaataagaccacgagtatcaattgtggagagagcctcagctgctccgacagataataggctgtttctccgtctcccccaagaacatgaatggcgaaagctttctcctgctgaaatacgtaaggtaattttaaagaaactttcaatctcacccgtattggttgggaatacgtgaggtaattgtaaagaaactttcaatctcacctacattggttgggaaaattaagccagtacgt

SEQ ID NO: 17 - DNA, 1749 bp, Artificial Sequence
  Synthetic
ccccccccccttccctccaccccaattatttaccgacactccggacggccagcaattgcccttcctcccagccccacttgtgaccgttgaagtcctcaggctgtccgtcggtctcgctagctagctgctgcctttcgctcgcgactcgcctaattcacactcgaacgtccgtgtgctcttggtccgatattttctgttcgctccctccaccacaaccttgggtctgtccttaatttttccaccaaataatcaatcctacgaccattgcgtgggacaataattcaataaggaaaatttaaataaaaaaaaatttaaaaaaaaagaaaaagaaaaaatttaattaaaatccataataaatactctgttaatatttacaagggaatcttaattattcaaccaaccaattatctcggaaaaggataaaggagttggaaaaaaaaaaaaaaaaaaaatttacatctaacgattagaaagcctttgaacctagtatgcccaattctcttcatatggatacccagtttcactcaaacaatatgaatagcagtacagcgaattatagttcattgcctagcatttcgcctcatcaactgcagcagcaaaatcaaatgccgactcatattctccctcctctccagcctgccccacactcttcgatgcagccaatgtatagcaacagtgcgcctatgactccgagaacccacacgtctccgaataccccaacatcgggaggctcgatgaatttcccacaaatgtgccaaacatcgccccgcttccaagtaatgacgagcaataatagcaatttacatccacggagctaccaaatgataagcagtgggaacgatcagggataccgaccgataacaactgtggtaccgcatacatccaacgctacacaaatgtcgtactctcaagtcagctcttcagtgccccaaaatcgaatgccaccacaagcaatgagacccatgtctcataacggaatgcataacatgcaaggtggaatgccgtctccatatgctccaaataatatgttacagatggtcgatatgaagtctccaacacatgttgtaggatcgcaaggtcgaagaggtatccttcctagtgccccaggtcgtcctccagtgaacagtaatacagcaaagagtggattaatagcgaccaaggacgccgacggcaaattcccgtgtcctcattgcaccaaaacatatctccacgcaaagcatctcaagcgccatttacttcgtcatactggagatcggccatatatgtgtatactttgtcgtgatacgttctctcgaagcgatatcttaaaacgtcacttccagaaatgctccattcgaagaggcaatccgaccggtgcgagccacttatctcactctcaagctcatgtgaagaaagcacaattaagcacatcaaaaaacattaatgaaaggatagcagaagtaaatagtagtatggcgcctcctaatgaggtgatccctatgtacagagttgctccagacggggcagttcctgagcagtattctgctgcttgtgtgtctagtatgagctaatggttaggtatcaattacacaattttcacgtaatatgggcggatttgggaacggtgtcgtcttaattgggttaattttgtttctcttacgaatttaattatagcaaccaaaattgttaatgtatcgagcagaagtatgaagggggctcagttcgaaatgtattgacttaacttttttgataatataatgaatggggcgt

SEQ ID NO: 18 - DNA, 863 bp, Artificial Sequence
  Synthetic
cccagttccccctatacccaatccccttccctctatcgcgtcaacttcaccaccgtctcaaacaacatcaaataatatatcaacagatacgcgtcaacttcaccaccgtcacaaaccacatcaaataatatatcaacagaaagacagatcctcaagcctgttgccccttcaaagcgtccgataccagatagacctcatcataatagcaggaataactctgacatcgcaaatgccttcctcccacaggaacttgccgatattattgcgactcgacagcgtcgtgaacgagcgtggtttcgacagcgtcgtgaacgtgcgtggcacgcgcggctaatgatatgcacaatgcacggctaatgatatgcacaacggtgattagtagcatagatagtacattagcgacttttacaaaagaagtagagatagaagaggctgtagctttcaaagcgtacctcaaacttgcaatagcaaactttgcagcagtagattcgtcccctcctccacctcgtgtcccattacatacaagaccgaataaaggtaacggaaatgatagcagtaaagggaaaagtaaagagaaaaacttgtcaaagatagcagtcgcaatacctcgtattgcttgtaatcgaattccaaatcttggttcgatcaaagaagtagaactaccaaaaattattaaaagatacctcgtattgcttcaaaaattattaaaaataatgatatatcatgggccacagtaatcaaaatccaaatctgggtacgatcaaagaaatagaattaccaaaaattattaaaaatatgatatatcatgggccacagtagcgcgcaaagggcagaaaaaagctcgaatggttcaaaagattaat

SEQ ID NO: 19 - DNA, 540 bp, Artificial Sequence
  Synthetic
cgaaaccgaaatctacgacaggtaaagcatcacgcaatataacggcgaaagcccacctgctatcacctactctcaacgtcctacgaaaagatgttgttttcgagaaagcgctcagtgacatgcatggctcttccgataaatacctagataaagactctagcatggaaattaatataggtgatgatatcagcgaggggtcgaatgcggatccctttgcagaagaactccccacgccatcaatagcgccagatactgcggtagctaccacacttaacttagcacatggacaggacgtgaaagataatcacaatgcggctagtctcatggatgcaatcaaaggcctactagacttgacaaatgattacttaaaaaatcttgaagcacatcacccaggagttggggcagacttcttagcgcttctagcggacggagcctcccgagctatgcgcggagagcgagtttattctaatacatcaaaagtatgcgaaggtagaaaacaaggaacacaggcaacatggactgagcctcacgagctatgcg

SEQ ID NO: 20 - DNA, 762 bp, Artificial Sequence
  Synthetic
gaccattgcaccgtataaaaaattcaataggcagtttctttttaaagattttcgttatcccggattcatcgaagactctgaatccacagcgaggagcttccgagaatagagcaagccaggtcctgtgaggtgcttctggatttgtagtaccgtataattttacgtgtgctggacgtttagatgatacccgctcaatctcattcatgagcattaacttagatacttcaacctgaccatctatggtaataattttttttggaactgtaggcacaaggactgaaatccagtaggggccaggctctagtgacgctccggacataaaaagccctccggaagcggaaagaaggtcttcactatatttcatgttgcatgtagttatacaagccctgatcgccggagatcttctctaaatttcatgttgcatggagttaatgcaaaccctgatcacactggcttaatgagacctatagaggctggggagaccgacaaacgtttgagtaccacctctcgaaagcccgcaggagtgctggggagaccgacaaatgtttgactattacctctcgaaggcctgcaggagagagtttacgccattcatgatctaggggaagacgaatgaatagtctgttgtctgatttatttttgacctctacatttttacctaagtccttgttgtgtgtcttaggacggctcgtcaagtggattacatcattaggactgatttcattctgagggtttactgccggtgttgagatccgcgatttc

SEQ ID NO: 21 - DNA, 5152 bp, Artificial Sequence
  Synthetic
ccgaaacttccaatcttaaaggtaatatcattagcaacaattacaaacttgcgaccacgtggatactctggtgttctagctgtgataatccatccaaccattccatgagtatttgtgccaggttcgcgatttacttcagcaagattatcagcatcatctaataccagttcactaaagtcaatacattcaccgatggcaggctgcttttcggcaagtgttgggtgggttcgtacagcttttgcccaacagttttggatggcttgacgaaaaagttcgggaaagtcataaacatactgtgttcccatgagatgagccttatatcgctttggttggagccattcttttgttggatagggcgtagatacaggtctcaagtgcatcgatcctattgtagtcgtgcctccaatactatgaaatacccattcaccattattttctgattttcgctcggcatacatctcaacttgaattacatatccggacgtatttgtgatgacaacacgaagtggataaggtacactactaactggatctgtacaaataatccgaatttcggcacctgtcacgcgtaacctccagagtcgacgaccgaatcgttccaagaatccacccaaggcttcttcaacttcagggggttggagagggaatacaggagaaaagttaataaagatgtgattgagatcagaattattgttaccgataatttccaaggcatcaagaatatcgttcataagtctatcagtctctgatataagatactcagctgtaggaatttcatctcgaagtctacctggacgaacaactgcacgagtaaagtacctcttgtcaccttcaacattatttgcaacagcctcatagatatgtatatttctgttctccgtaaaaacaggcttgactctaaattttgaaagtctaccaagttcaagctggaatgccaaggcgggttcaatgtgacgaatactttgatcttcctcatattcgggaccacggaatgtaaaatatcctggatacgatccatctttatgaccacaaatgattgttaagcgacgtacacgtcgagagagaagttctgatttgttatccttaacgattgagttgattctagctagagtttcattatcttcaatgctctcagcatcacgaacagctatgtttacaaccgctgtgagttcttcatcaagatttggtgaagggatagttttccgttttcctgctaagtcaggcattaatccatttggatactttttacgtccaggtaatgtttgtaagatatcaagtgctcgaattaagtattcttcagcttcatcaaggtaatgaacggggacaatgacaccttttcgtattggttcataactctctcggttaaccaaatatgacatatcacttattgacgcaactcgctgaaaagaatttttgaagtcctgattactggcaggtgtagccaaccccgattgagcaggtaaaccaaattcagaagcaccaacttttcggagaacaaagtcccaggagacaatgaaaggcgcatcagaattttcattgtgatattcaatttttttcaatgaataagctctgtaggcccgtctaacatatacttcaagtgctgctaaagacacccatggatcttgatgtgcaaaaaaaagcggaagaacatcaaatactgtatatttagagtccacaacttcttttaatacctctaggtcgggctctcgatgttcccatcctgtctcaccataccttgactctaccacggaagaccgtaatatatgctccatttgcgcagctcgttcctcaagagatggcatagcacattgaattaaaagttcgcgagcctttaaagatacttttgcggtttgtctagactcaagttcagtcagctttcgtaatgctgatctgaagtattgtgcaaagttgccaacatgtgacttgttaggtctatattcatctagaatagctaatattagattatttttcgcaccaattcgactgtgggagaggactatctgaataaccctggcgatatcgtctttattttcatcgcgaagtttcagaatcacttcttcgtcacgagccgtccgactagagaagagtttttcgacagctgcataacgctctagcaagtcagcaaaaacgtgatattcacgaactttttgactttcggcgtatcgatccaaaacctcaattaatggagcgattgtagactttaacatttcgacatctgaaggactaacgttttcatctaggtatctagccagcagtttggataaatttttggctggaaattctgcttttcgttgttttgctcgatcaacaacttgagtaaatgtagtagctaaacgattcggcattcttgaatgtaaggcagaaaattgggcattccattctccgtagggcagttctggattacgtaagacatcaataagttcccttaaagttgatgccataattacttgattatcaaatccgtcaagaatatttagcaaaacattatgaagcaatgcaaacctttgtgcaggttttgtaccgacaacttgaggaggtccgaagttgggcaattgacctaggaaagtttgtgcttgcttaactctagatggatcatctaatgcaagaatgcctaatatgtccccagcttccagagtagctccaggttgctttattagttgaactataccatcttctgcagcaaggagtggcatatacatcttcataacttcaacctctgcaaatggttgtccagctctcacatgctctccattttctactgtgtactttactagttttccaggtgatggtgttcgaagttgtgagggatcgttttcttgctccaggagacatgtcttactgtcaacgcttaagcgagtagcaccaacttcctctttccaatacacattatgactgcgcccactaacaagaataagaaggcctccgtcactcaatgcacgaactccaacagaacactttgagccattgataaataagtgatagctatccatacttgacctagttgcagtaaatttatatctttgcccatcatatatgaagtcaattgagaagacagtcttcaaaatatcttttgcaggaacttgacccttttcaaggctagcccggtattccgagatgcatgattcacttgcgatatgagcttttgtaacagctccacagacaacggcaagaatggggtcaggcctttcagctgttaatttattagatattaattcatctagccatccagtcgtgattgtattttcttcaaatgctggggtttctaaaagttttatcaaatactcaacagttgttcgaaagtctcctcgaatacttaattcctttagggcaaccaccatatgtttgcgcgaagctgatctattttctccatatgcaaaaatatgaccaaattgactgtctgagaaactatgaataccgccggctgtaccgacagagaagtatccccagacattcgaactacttcggaaatttaattcatgcatcataccgcttgatggtttaaagccttctccaggatcttcagaagtgatacgacaagctgttgtatgtccttttggtgttggccttctctgagtttcagaagaggattctttggcaaaatcaaaatcaatttctgttgatccttgagggtcgacaccatacaacaatcgtatatcacggattctatgtagaggaagccccattgcaatttgtaattgtgcagcaggcaaattgacaccactaaccatttctgtggtaggatgttccacttgtaatcttggattcagctccagaaagtaaaatttatcatcagcatgtgaatataaatactcaacagttccggcagatacataacccacaagccgtccgagtcgcacagcggctttctccatggcttgaaaagtggatggttttgcgattgttacaggtgcttcttcaattattttctggtgtctccgctgaacggaacaatctctgccgaacagtgaaatattattaccatattcgtcagctagcaactgtacctccaagtgccttgcatttcctgctaatttcataatgaaaatgggggatccaggtatttcatttgctgcagcattataaagcgcttcaaaaccatcttcagaatcggcttttcggatacctttaccaccgcctccctcagaagcttttatcatcacgggaaaacctatctccctagcttttgcgagtccctcttgccatgactggacacatcctttcatatatacagcttcatctaccgtcactataccatcattatttacttcaacctgattgacaccagttccagaccatggtatacatggaacttctgcatgttgtgctactatagtagaagaaattttatcaccaagtgatcgcatagcggagccgggagggccgataaagactattttttttggacttgctgccaaggattcgggcaatttaggattttcagaggcatgtccccatccggcccaaactgcgtgtacatccattctttcagcaacatccacaatcaattcaacgtttgcgtagttattattatttgtaccaccaggcacctcaacatactgatctgccatgcgaatataatcggcattagcttgtaaatcttctggcgtagccataaccgtaaattgaatcgcccgttcatctccgaatgtttcatatgcccattttcgtactgatcgaatctcctttactgcggcaattccattattggcaattaaaacatttgtgataacagtatgtccatcatgctttttgacgaaatcttttacgttactagatggtgcgttttccagcttgttgcctccgatgaaatgatcagctatttgatgtcgcgaagcatatgaaagtcccctcaataagggcactgtatgatttgctttgttaacgtttccattaacttcagccattgaatcgactttttaatcggttgtgtaaggtaataagtgaaaatattaattgtagaaacaaaatatcaagcccaagcaagaaatgaatgcatatgaagtcaaataatattttcttatcttagcctaaagttgattgagtgtcggctcgaaaatttttagacacctaaatgggtctacctcaaacggcgaattgaagggaaaaatagagatatagggggaactgggaggataggaaaacgagaatgggg

SEQ ID NO: 22 - DNA, 625 bp, Artificial Sequence
  Synthetic
gtaggctttgtttttggaattgttggcggtgctagccttgccgcttcttttcgttcttctattcttctttttttccttgcttgaaattcttctcgtggaatttcttcaagaagctgagtatccttgagactagctctaacaggtaggggaaactttggactatccagataaactttctgataatgcgccttaacttcgtccttgtctcgataacctccaatatggtctgctatatctgcccatgatccaaagccatatatttcggctccctccaaaagaagtaattcttcatcagcaccccagtttctgtcatatatgggaactgaattttgctctattactcggtatggatgggttcctgggttgtggttgtgtgaagcttcgccatttgagaagcatagcacacaaagatcataatcatgacagtgagggtcagcacacctaattcgaactgtcgaggtaatgtctgctgagcatacatcgcatacatacttaacacctccctcggcacctcgggtcgcagtcttcttcctgatttggcccattgctaaaactcatggtcagtactagcaacagagctccccttggtagcacgaagttaaaactgcaaatccttaaaattttc

SEQ ID NO: 23 - DNA, 665 bp, Artificial Sequence
  Synthetic
tgggtctgtaattccaataacatcatgttctggtgcatagcctgagctggccaatgccttgagcgtctgaacaagacttccagtgagtggtctaaacttctctactatattctcttcaccttcttcatcagcttctatgtcggcctcgcaaaggctagtgacaagtgtcaagccacaaaggagaactccatgatttcgatctgaaataagtgtttctgctttttcgaagaaatgctcttgaagatctggcactttcttgcaaatacgcatagcacatagagcagccttcttacgaatatatgggtttgctgtggaaaggagattttctatctctggaaagagatctcttgacatttcgattgatgcgatgttgcctagcgtacagagggctagtccgactatgtattgattagagtgattgagatcgttctttaaggagtttgtaactaaggtaagaacctcttgattttcgtctaaaagcaacatggtccctaagtaaccaaggcgtttgtcggcgaaacgaggagacgcaagtaatttaaggcattctatctggccaaagtgggttctttccccaagtgtgaagagatataacaactttgcaacgttattacgtctgacattggagtcaccgctctcttctctgaagcttgctcgtattgccg

SEQ ID NO: 24 - DNA, 1439 bp, Artificial Sequence
  Synthetic
ttggtgaaagttttcctgtcataagacgaagtagtgttgactttccaacaccattaggccctaccaaagctgttcgagagtccatatcaacacctagatccaaatgtctgtataaatcatctttaggatcaccagagtatgaaaaagtaacatcgtcaaatgataacactggtggaggaagtttttccacgtctgcaaatctgaaagtaaagatacggtcaggctcaactttttgaatgaagccatctgcttccatcttgtctagtattttttgtcgtgatttagcctgtctgactaagttggcataagtaccagcagatgcaataaattttttgatatgagcgatttcgtcttgttgcttgtgataagctttcatttggttgacttctaactcagagcgggtcttttggtatgtatcataatttccaccataatatgtaagttgtttttgccgcatatcaatcatattggtgcagactccatttagaaagtccattgaatgagacactaatacaagacttcgatcccacttcttaagatattcttcaagccacacacaagcttccaagtctaagtgcgcagtcggatcatcaagtagaagtaaagatggcttaacaaaaagggcttttgctaaagctacacgcatacgccatccaccagacatatcttttgtttttttactgattgtcttcttattgaatccgagaccagtaagaataagtgaggcacgagtggaaaacgtcgatggatccatattttccatacgctcatacagatccatgagcaggggactttcaggtccatcatcctcaagaatttgttcggcttgtttatcgagtctttccatttcattttcagcctccttaacaacccattccagtgccccaagttcgcttggaggagcaccttcgttcaataagtatatatccacatgttctggtattggatattcgcgtttatcaatggccttgagaagtgtcgattttccgcatccattttcaccaagtaagccgtatcttctaccatatgtaagttccaatatagtgtcagatattaggacacgaccatgaaaaacgagagaaactgaagttattttaacatccctactctgcttaagagagctaagaacgccagttgtcacccggtcggaaaggccttgtttatccatttgacttgccagtctgttgatctcatcatttttgagagaattttctgtctgctgatcatcgggaagagggtttccatttgcatcaagaagaggtgttttgttccctgaagcattcttagagtttgtctttgatcgagaagagagtggtttcttcgtagtctttccttcagcagctcgtttagcctcacgggcagccttagaagcagaaaccatactgctttcacgagtagaccaaaataagaggatataggtattacaaagtcttcctaat

SEQ ID NO: 25 - DNA, 484 bp, Artificial Sequence
  Synthetic
cttgtttatttgcaaacactagaagcagagactccttcatttctcgatcattgatgatgcggtgcaattcttggcgtgcttcgtctatacgtgctttgtcggacgagtcaaccacaaaaatcaagccctgtgttccgctgaaatagtgtctccataaaggcctgattttgtcttgtccacctacatcccagacattaaacttaacgttcttgtacgtgactgtttcaacgttgaatccaacggtcggaatagttgtcacatcttggttaagttttagtttatacaagatagttgtcttcccggcagcatcaagtcctagcatgagaagcctcatttctttcgaaccaaagatctttcccatcatcttagaaagttgaccgcccatggtgaagatgttaagttccgaggaccagagaaaactcgtgtatcctgatcaatgaacaatagcaaaatcttgaatacttatcgccccccttttagccgg

SEQ ID NO: 26 - DNA, 614 bp, Artificial Sequence
  Synthetic
taaagtgtatcatagcttcatagattttcagttgtcttgttttactgtctccactagccagtccattccctcatccacaccactcccatccacggcactacatgcaactatactccaatttcggtctcttagctctccaagtttcaaggcttcacttatttctcccgcaccctttgcaccaggctgatcctgtttgttcgcaaaaaccaataaagctaatcgatcaatatctgttgagtctataacgaagataactgcagcggtattggaatagtagcaacgccaatatggtcgtatagatgtttggccaccaagatccgcatctttaagctcgtcttcattgagcattgcagcaagttcgtcatacacgtttagatgacttagatgaagagaaaagggggagaaagaacaagctttaggcttacccaaacattaaaatttaaattcttaaaggtgatagattccacattgaatcctattgttggtatcgttgtaacaacttctccaattttaagtctatagagtaaagttgttttgccggcgttatccaagcctaggatcagaattcttatctctttctttgaccacactaatgatgatagcttagaatacca

SEQ ID NO: 27 - DNA, 745 bp, Artificial Sequence
  Synthetic
cactggtggtctaccttctttattccatgtaactcgagtcctaacccactcaatcgcttctctaaccccagtacctttgagtgcgcttaccggcaaaactcttgaatcccgaatggcaccgcccatagctccttcaaaaacgtgtttgacaaatccctctttgattcgtaccacttcaacgcaatcttcacgatcttgcttatttgctaatatcaacaatggtacaccgtcaatttctccattgaccaagacttcctccagagccaatcgacactcttcaaggcgacccgactcatcatgctccaaatctccatcaccaatctcagtgctatcaatgaggaaaataatggcgtggcatgatcgatagtaagatttccatagtttgcgaagagattcctgaccacctacatcccaaagcttaaggtacatgtcaggcagcgtaatagtgctcacattttgtccgactgtaggtcccgtatttattttgggtgcaggcgcatgaggcaggaacaggaatttaacttgttcgtgaaaagttgtcttgccggcgttatcaagtcccagcaaaagaaccgagtattcttctttgcgcgttgcgtagtggtagagacccttaaccaaatgatacatgtaggtttagatctacataaatggagaaagaaatcttaattagaatgggggattctgtttctcggtcgcttctcgaaaggcgagatttctgaaacttattcttgtatcgcagaag

SEQ ID NO: 28 - DNA, 943 bp, Artificial Sequence
  Synthetic
cggcgcaacagttttaataatgctcgtgtttacattcatctcactatcgcttgtttcttgattaatacttaatagttgcgaagtataaaagtgtaaatctgtgcttaaggttccagtcacagcctgcatgttattttgagttaaggtcccagtcttgtcagagcaaatagctgtagcatttcccatgacttcacatgctttaagatgtcgaacaagattattatcttttaacatacgtgtagtagcaaatgccagtgccagagttacagctagaggcagaccttcgggtactgctacaacaattacagtgactgtcacaatgaaaatttgcagaaattgctgacctttaacggttggtgtagcatcattgttaggtagtctagccagaaactcaatgaataagactgtaaataataatagaccagctcctcctccaagtttagctatatactctgctaaattgttcaattttgactgtaatggcgtgatttccggatcttcacggagcgacattaatgttttcccataactagagtttacaccagttgaagtaactaaaaatgtacccacaccttcagtgacagtagccccagacaaaataaatggatctaatttttctagcttttcgtggttcgagatagcagcataaacttggtctgccggatgcttgcgaataatatcggactcgccagttatttgagactcatcacatctaagattatgccctccaataaaaattccatcaacaggaatcatgtcgccaggttcaagatgtaaaacatcgcctacaagaacatcatagatggatatttccgaagttttcccggaacgagtcacatttacatctcggtcttgtttcttacggttgagttttacaaactgtcgctccttctgccagtcgttaagggaacctacgagcactacaattacaattgcagcaatt

SEQ ID NO: 29 - DNA, 1145 bp, Artificial Sequence
  Synthetic
tcaatatcttgttaacaggtataccatccaaatgaccatttacacctgcgtaaattataggaaccatttcgttaacagccattggtgaatattgcttttgtttcaaaagctcggttaatcgttcgcctcggttgagtgtttgcttagtagcagcatccaagtcggatccaaactgggcgaaagctgcaacttcacggtactgtgctaagaatagcttgagcgagccagcaacttgcttcatagctttcaactgagcagctgagccaacacgagatacagaaagaccaacgtttattgctggtctgatacctttgtagaacaattcagcctctaaaaatatttgtccatccgtaatcgaaataacattggttggaatgtaagctgagacatctcctccttgagtctcaataattggcagagcagttaaagagccacccccgtgtttgtcgttcatcttagcagcacgctctagtaaacgtgaatgtaagtagaatacatcaccggggtaggcctcacgtccgggaggtcgacgaagaagtagtgacatctgacgataggctacagcttgtttagataaatcatcgaagacaataacagcatgttttccattatcccggaaccattctcccatagaggttccagtgaatggagcaatatactgtagaggagcagcttctgaagcagtagcagcgacaacaatggagtacttcatggcgtcattttcctcaagagtctttacgagctgagcaacagttgatcgcttttgtccgacggcgacgtagacgcagtagagctttttgctctcatcatttccaacattccatcgcttttgatttagaattgcatctaaagcaacggcagtctttcctgtttgacgatcgccaatgattaattcacgctgtccacgtccaataggcaccatagcatcgacagacttgagaccagtttgtacaggctggttgaccgacttccgaggaagaatacctggagcctttaattgagatcgacgcttctctgtggtcttaataggtccttttccatcaatcgggttaccaagagcatcaacaacacgaccaagcatttcaattccgacaggcacatcaacaatttcacctgtacgtttaacagtttcaccttctttgact

SEQ ID NO: 30 - DNA, 725 bp, Artificial Sequence
  Synthetic
ctcatcttggtcagtctcttctccattgatatatgatagtctttgatcagtctgactgctatactcactaccagagtcactgattacctgtctgtctctatcgacaattccatgaggtgattttaaatgagtgatatgttcgtcaatgacacttagagtttcattcattacagggctatcttgacgatgattcttaatattaacagacgagatactttttgattgaatcgttgtttcaggactagtaatcgttaagtttgacggagccttgataccccggggcccaagagttggttgtatttgaggagtatctaacattttgagaggttctgatggcaaggagaccgtattttcaccagaaaaaggagtttgtggagaaactgtgttgctagttttccttattttggaatgggaattttgaatggacgatgatgctggcgagcatattaaagatcctcggggagctatacgtgtgtatacttctgggaagaggccactctttccatttagcagatgacggcctaaaaaccatccgtccccaaaatcatcatcacgttctatcaactcaacgcgatctcctttggacaagctcaactcatctgagctacgagctgagaaatcatgaactacaagcaaaatatgaccaggttcaggagctcccatagcctcaactgttcgcaatgtcatctcttttcaaaacggatgtttcatatccctcctagcgg

SEQ ID NO: 31 - DNA, 677 bp, Artificial Sequence
  Synthetic
acccgcattagtttatcgtgctgtgctcgatatgaaagaacgagtgacgaaaaatactagtaatgatatacgtgttgtgaagaagaataggagaaattttagtaatttttacagaatcaaacatggacgatgcttccttttgggggctggaggttctaatgccgccacaatagcctcatcgaaaacatcttttaacttgtattgtgtcaaggcactgcactctacatattttacagcaccaagatcttttgccattctctcaccatcctctcttttgactggttgcattttttgtttgcttaatttttctcggacactaggatcgtctcgtaaatctgtttgagttcctacaattaagcatggtacgcctgggcagtggtgatgaacctcgggaaaccatttctcacggacgttttcaaacgaggcaggagaggtgacagagaaacacacaagaaagacgtcagtctgtgggtaagaaagaggccgaaggcgatcataatcttcttgtccagcggtatcaaaaagacccaatgtataaggctcatcgccaatcataacagtaactgcatagttatcgaataccgtgggaacatactctgagggaaatttattggttgtgtagctaatgagtagacatgtcttccctacagcgccatgaccgacaacaacgcatttta

SEQ ID NO: 32 - DNA, 1502 bp, Artificial Sequence
  Synthetic
tatcctcatctaaatcaatgaggtccattttctcccgaatttgctgcatagcagcttcagagcagagtgatgctatatcggaacctacataaccgtgtgtctccgaggcaatctgttcaaggtctacatcttcaccaagtttcatgtttttagtatggatttggagaatctcaagacggccagttggatcaggtatacctatatcaacttcacgatcaaatctgccgaaacgacgaagtgcaggatcaattgaatttggtcgatttgttgctgccataactacaacatttgatctagctttcatcccatccataagggttagtagttgagagacaactcgtcgttcaacttctccattggttttatcacgcttgggagcaatagaatcgatttcatcaatgaatataattgcaggagaatttttttcagcctcttcaaatgctttccgtagattggactcagactctccagccatcttagacataatttcaggtccattgattaaaaagaaaaatgccccagtttcgttagccacagcccgagccataagagttttaccagttccaggaggaccaaacatgaggacaccacgtggaggtttgattccgatagatttaaaaagctgaggatgtcgtaggggtaattcaaccatttcccgaatttgagccatttgttttcgacagcccccgatatcatcatatccgacctcatttaggttaccttcctcatcttctcgttggataggttcaccttcacaatgaatgactgtgtcctgagcaacaattccatatacaggaggatcaacctctacaactttaaactcaacttgtcgcataccaccacgtacagtgaaaagatctccctgacgaacaggccggtaagcttcgcgaaagtaaggtgcaaggaaaacatcaaagagggaaccagtaaggccttcaacagtatctgcgataggaagaactgcgatacgtttggcgtattttatatcaggacatggatgtactgtaacaatatcaccatgtttaaccctaaggttgtgtcggacaacacgattcatacgagcactcccgtcatctaaatcatcatctgcgagtacaattaaaacagtatcctttcgcttcttccccttaactaggacagtatctccacgaaaaagctgcaaagtttccatggtattatttgacagtgcaataacagagttatcatcgttgatggcatctgttacaattaaggaatttggctttttcttcttttttaaaatagcagtcgcagtagcatcaatcgtcttttgttcagcgccagaggcatcctcaagtttaactgtttttttacgagtagcattgtcttcagacatagttgtgtaataaaagttaagagggcgtaatttcctagaaagaatatatctactattaatttattgagatcttggaatgaaggtttatccgataaaatctgtaaatgatggagctaatctgaagcgccactggaagagttctcgtcaa

SEQ ID NO: 33 - DNA, 1614 bp, Artificial Sequence
  Synthetic
tgctacgcgtatatgaggaatagctaagaaagggttggtgtgcaaacaaggtagaaaacccgttgatatttctaataccttgaggaatactgcggaatatatacgacaggtgttaaatcgactcaagctagatgatcaagtaaaattaattattcaatttaacgtattttaatttgatagaaatgtaatccagacaaaagaaatttctagattacggattatttgctcagctgaccgatcagctttctagtaccccgtctagtctaatcagattgacagatcagagactatgatgatcaaaattggaccgacactatttttgagaataaattatatctaaaagttattctactgcggtacaggatgtttacttttaaggttttcccatcgcgaagtagttaaatattgataaaagacgtagtagataacaaattttggtgagagaagtttcaaaagcggttctttttgtgcttagaatacagttatgtaaaagacgtgatcaaatttaatcgtaaagactatcatcgttaccagcatctccaaatccaccggtcccagatgcagcagagttgtttgtatttccaccctcagggaacttaaaaagagtcccagggcctgccgttttcatactttgtgcaaatgcttcgtatcgtcgaatttcaacgtcggagacagaacgtctggcagatgccatagcttcggcaaaatgagccttagtcaacatgggcacaggatcttctaaatcttcgtccatatcgacatcttcattcgcagcttcacgctctttacggcgttgaatttcaagagatattgactctttaatcgcaagttttacagcgcgctgagttatgaagccaaggtcagcaccggaaaatccatgggttttcgatgcaatgtatgctatgtctacatctggagaaacaggcgttttccttaattgagccttgaggatacccacgcgagatgtttcatttggtaatgggacataaaccagggtatcaagacgacctggtctacaaagtgcgttatcaagttgctcaggtctgttcgtcgcgccaataacaaatacattctttttagatgtcataccatccatttctgttaaaagttggtttacaacgcgatcagaagcaccgccagcatctcctactgatcctcctcgtgactttgcaatagaatccaattcatcaaggaaaacaacacatggtgcagcagctcgagccttgtcaaaaatatctctgatattgctttccgactctccgaaccacatactaagaagttcaggacctttcacagagataaagtttgctgagcattcattggcaacagccttggctaaaagtgtcttaccagttcccggaggcccatagaaaagaacacctcgcgaaggcgagagaccaaacttatggaatttttcggggtgatcaactggatattgaacagactcaattaattctcgcttgacttcttctaacccgccaatatcatcccagcgtacatttggcacttcaacgacagccacctcccgaagtgctgatggattcgagattccaagtgcgaacctaaagttttccatcgttacccctaaagaatctagaacctcggcatcaatag

SEQ ID NO: 34 - DNA, 1483 bp, Artificial Sequence
  Synthetic
cgaccgattaatcccattctagacaagccaaaatctgtcaatttaagatggcctttctgatcaattaagagattgtcaggtttaagatctcgatgaactatccctcgactatgaagatgtttgacccctaggataacctcacctaagtattttcttgcccaatcctcttgaagaccgcctaaagcctttataagtgacgcacagtcgcctccattcaaatattccataaccaagtagagatagtctttacttgagaatgtccagtataatttagctacaaagtcactctcaccttgccacatcatgattgcacgttcagctttaacgttagttacctgatttttggctaccatatcggcttttttaagtactttgattgcatagtagtcacctgtagattttttcttggcaagataaacacttccgaatgcacctttactgataggttttattatttcaaagtcttttatggagggtggaacaatacgggcttggggaacaccgacagttgataaacgaggtgatggaggtagtcgagatgggtcagagcctgcagcagaagattgacgtctatggtgatgaggtagaagagcaggggagctgaattcactcccgttatgcattggcgatacaactggtgatgcaaccccttcatgattggctactagagagcgaggcttatttatcctaagtggtgaggatggttgtggaagtctaacaggtgattcctgtctacgaggtgaagagctaccaggaagaatgatgcttctacgttgacgtggacgagaacttgctgcacgtcgaagatcaccaatctcagagacaggagattcattccttgtgccccttgtcattactgataatgaccttacactgcaatcactatcaccgccagtatcactttcaaagaggagtgagtgtcgatagaagtctggattatgtgggaaattgctttgactcctggcttgagactttgatactaaactttcttttgggctactcgatcttgtcgatgattttgctgtgggtgataagtatttctgtccatcgcgggttagctcccttgcaacccttacatttgattgtccacttataggataacctgcactactttctatttcataagtttcagcttcatcttcatccgaatcagttaaatatccagctgcaatccttgcagccttgcgtattgcctcatcaatacaatcttgaaccagaacggaaaactcgattctgattcgttctgtatattcaataattcggcgatatcgaatgacagcctcaacttttgcttttgctactttctccgtatcagcgcaaagtaatgctaatccttgttcctgatcaagcgtattagtgcttggagattgccattgtataacctgggagattcgtccttctgattgaggagattgaacacgaaattccccaagttttttggaagcagattctttaaattctggtgtgcttatctcaattgcag

SEQ ID NO: 35 - DNA, 521 bp, Artificial Sequence
  Synthetic
ctgaatttctgagttccgctatctttttatctcttctttcctcaagtccgtattgaagttcgtgagataatttacttcgattcatctctcttttactttcttgtgcctcccatcccatttttttacatttcatcactaactcagttattggctctatactgttagccccttttgttcctgcatacatctcttccatacaaaattttcgcgcagtctttgcagattgaaatgcctcatcgtaataatttagcgccagttgtgcttgggccagttggaaatatgctttcatatttgatgggaggagacgtaaagcgcattgggcatcttcaattacacgatgatgaagagataatttaagaagtaccattgcacgatttgtataaagtactggattttggggatcacaattgatcgcttttgtgtaaaacatttcagcacgcgtataatcaccagacttaaaatatttatttccttgctctttgaaatctattgctgctcgcgtatcatgaggtaggtcttgg

SEQ ID NO: 36 - DNA, 2729 bp, Artificial Sequence
  Synthetic
tccctccatgccatttgaacatctgggcgcttcatgcgaccaaagattctaaggaatattgacggtatccaaaatgtaaaagcccaaacaatagcaacccagactctgcgagttgtcgttaaggcttctgtagtcatatttttctgcccagccatttccgcgtctgtatcatttacaaagttaccgagttgatcactgtagtaaatgttacctcttctaccagtgtcaccttttgtaccaaggccataatcaccagcactagcgtttcgggctgtaggtgccattgagcgagcagtgcgagcagcatatggtaatgttgcttgactttgatttctttgaagaagattatctctactcccctggtgggataatccggggatatccaaatatggaaagtagccactgctagcgttaggttgacttccattactgttacccatctctaaaccatcagagcccatgataccacctccgttatgaaatccttggctttcaactggcttcatatcaagcatgctttctgcctcccaccaaacattctcacgcatccagatacgttctttgccaacaaaaacttcaccattactccacccacgctccatgatccagctttcaatgcaatcccttccatctttgcaaccaaggaaagcatatcgttgagcgaattcttcaatatcaaaatcagctgtaaaatctagacatctatttctccgatttgcccactctggcaacctccaagcacgtatttgtctagagacagctccagctgaccatgcagatgttattgaaggtagagaagcgagtattgctggtgtgtcatcggtagggtgaatatttagatgataccacacgcggctacatcctagaagattgccaatatctaaccttccatagccttttggaaaaacaccctcgccttctacaggatatatgattttcttgagaaatccacttacttcaacctcccgacctactttttcgagaatagcttcacatcggtcctgttcatgctcacgttcacgacctgctggcccagtcatgatacctagatcaggagctacatttgcgacgacgttctgcatatcgcgtagaattgtcgagctagcagtgaccacatctatgccatcatctttcatttcaaggttgataccctgggtatcgtcaaaaactccacgcatagctacagctttacctagcgttaaatctgaaatctccagtaccgtaatacaaactgtatctccatcgtcttcctcggaattaggtgttcgtgctgctgttccaacatcagaagaatcaccatcccttgatcgcaatatttcttcagctatagtttcattggcctttgcaattacccagtcaaccaatgctccatataacccagctattagagtctctcgttctgaagtcgtgcagttttttgttagaatttcgggttcgagtcctaacaagccaccggcatcttcacaaacctcctctaagacttcttcgtccatcgttagtgatagagtatctccaagttttaataggccagctaatatagagattagacttctgtgggtagatcctttaataccaatagctttgagagagtttcgaaagtcatctgcagccgcagtatcatctgccgttggtaagtatgatggtgggttgaaagtaccagatttagttagaagtgcatattcagtcgcaggtttgaggccaagaaactcccgctccgcaggtgtggaagctgatgtcagtaaaaagtaaaatacatcaaagactcggtttccaggttgggatgataagttgattaatccctttgaagtatcaattcctccattagataaagctacacttgctccagttaaatttccctcaagtgtcatagtcagtgtgattcctagtgctttatgtcgtggcgtgcatggattttgaggagtaacagcacataaaaatggcttaatgatacttaatgctgtaaataatgagggtggtaaagagagaggaagagtctccaataaaggtatcagcaaagaaggtgaagattcgtgaagagacccaagtacaatacaaccatcttcagcacgacgtcttgcatgctcccacgccctgcatgataactcggcatcaaccgtaccaccaactttgccatcagcatttggttgagaagcagccaaccatgtattaacaactaagctagtgcttgcatcaagtttatatgattgcgtagacgtgtaagcagtatggattgagtttaggagagtagtcgatgagacttgcgctggaggttgagaagtagaattgttatttcgaacacctccatacgctgaagaggtagttgaatagatagacatccggtgagttccagtcattttatgaagagtgatcgagtttttagacctttccacgtatggatatttaaggtatgtaaatgagtcaattcaaagtcacaagattctcgatcagtcgattgattggcttattgacaatattctttagccgaaatcttagacaatggcttgacagaattaatgtctggtcttcgaagtatccagttggtgtgtagcagataacttcggtatagttgtagaaatggaaaacaaaccgcaaaagacagtcttgtatcgaccgtgaggccgacagtaggagaaattcaatgctattgagaaattgaacaaccaaaaagcgaaagtagggtaacaagtttcgactcacagacctagtgaggtgggcatgatagggatggt

SEQ ID NO: 37 - DNA, 1132 bp, Artificial Sequence
  Synthetic
cggaaaacatattatatagaagttggacatgaagaaagaacattcgaacaagattatgtccacttttatacattcggccaaaatgcatgattgagtacatacttgctgcaaaagatccattaagccatcttcttctctgtccaataaactcagcagcaccttcggggacgtcggtctcaccctttgcagctttgatatatgtcaagtgccatttggatccagctttggcaactaactcaaagcagagaattctgtcctcagctaaaaacatattttttttaaaaatattcattccctcaatacctttctttcctaattttttagagagtgtatgatcaccatgaaaatactgttcaagaggccgacccattatagctcgaaagcgatacgcagagaaagctccgggtaatacacttacataaccaaatgaactttcaagaggcttatccaatatattactaattttgtactcaaagttttgagcagcaactagtggattaaatagtttgcgacctcctttacccaacattgcgtggatttccccacacgcgccaccgagatctttatcgttatagaagccttcccatagcgccaataaagattttgttccgggcctggttccagcatcaagtaaaatacatacttctggattaagtaatcggccaaaagcattaaatagccatcgatgtgaatttattttcttgctatttttttgctttaagcaaaacatcatctggacaggaggcaatgtattagagctatcatcagtaggtcgaatgagttgttgattagctgtgacggataactgtgtagtatattcaaaaatgtgggcaactgtctcttttccgtctacatcctttttcattacaccatcttgataaataccaatggtggctagaacatctagagtatctttatcacagggatcgattccgtcgaatactagacatacaacaattttttgccaggctggaccaccgacattccaaaagtcggatttttttaaatttactatatctctgatatttgtcatgacgccatgtagtgtgcgtgcggttaagctcttatcctcattataatatgtaattgcaatcaatagttccgtgtgacgattatacattgcaggtctaag

SEQ ID NO: 38 - DNA, 912 bp, Artificial Sequence
  Synthetic
cttgcttgtctttggtaataaagaaaatgttgttttggtatgtagctgatgctggtctttctctctcaagcttgaagaccataacgccattatcatgtccggctgcaaacaaattaatagttggatgagctgcaatgacccaaaatcgatcattctcccttttgaatgactgaacagaagtacgtttatttaagtcccaaaccctaatagttttatcttcaccgacagagagtatcagatcctggtgaggatgaaagagacaacaggatgcattttgaaagtgaccacggcaagtatctacttcccatgcttttgtctcactcattcgccataactttacaagacgatcatcaccagcagatacaatcaatggtaaggttggatgaaaagcaacccagtttacccctcgatcgtgaccttccagtacaaactttacaaccgcgtctgtatttccaaacatatctgcctgattctggttacttcgtgacatctggtcttcgaatgtcattgagttaggtgccgagtgctttttgcgtaaccctgaaatatcccagacacggactgattgatctagagaggccgacacaactaaatcatcttttggatgaaattgagcacacatcgtgtagtgattgtgacccgtcatggtgcaaattagtgacctattctgccaattccatattctgattgtctgatcgtcagagctcgaaataatccacgggagctcgtgatgaaaaaaaacagttcgaacataatcaagatgaccacttaaggtaaaaagacatctgcgggtttgatatgaccatactttaattttgtagtcatctcctcctgacacaaagagaggctgagtcttgtggaagtcaattccccgaacaggtccatcatgctcctcgaatcgatcgattaaag

SEQ ID NO: 39 - DNA, 453 bp, Artificial Sequence
  Synthetic
gctctgagttgagaggcattatcagtttgatctatttcatcaatagggaagtaagttgtatcaacgtttgatgatagtttaggttcaaaaggtgcacgaatccttcgaagactatcaaagtctacaccacggaagaactgatgtgccttaatctcatcagcacttccccttcctagccgattttcagtattacaaataagacttcggatcaaattttcagcttctggccctaattggacatcatctgggaagtaaagagtatgtcgccagttaacaatcttacgataagtatcatgagaatcctcagcgcaaaatggaggccatccaatttgacattcgaacataatcgtgccaaggctccaccagtcacagtcctgaccataaccctgaccaagaaaaatttcaggtgctatatagtcgggagtaccaacagtagaatatgccatggttcgc

SEQ ID NO: 40 - DNA, 590 bp, Artificial Sequence
  Synthetic
tttccagaccctctcaaatgggatcctcatcgatgggacattggatcaggtaaagtcctaggaaatgatgcggttgatgagaagtatgattatgggtatggtttaactagcacaggagcgtcaagtccatatctaccttttggtgcgggtcggcatcgatgtattggcgagcaatttgccacattgcagctagtgacaataatggcaactatggtgcgtttttttaggttccgtaatatagatgggaagcagggggttgtaaagacagactattcaagtctattttcgatgcctctcgcaccagccctgataggctgggaaaagagatgactgttatcgtaattatttatggcaggtgttagggttagaagaattgtctaaagaagatctacttaataagcaattgtgtttgacaaacatagcgtacttaaggggcttgaaccacaaatcgaaatgcgctaaatgtagttactacccggttagcagtctttatttcaaagtagagacgggataaataagcaagcttaaattctagtgtacgcgcttaggaaccgagatacgaagacccccatccccttcagggagttcag

SEQ ID NO: 41 - DNA, 401 bp, Artificial Sequence
  Synthetic
cgagctcttatagtgtgagatctgcagcgagtagtatctactactatgggcaccgaaatcttcgatcttagatagtggtatcgtttgataaccatcgttagttgacgattctgccgccttgtagttttctggataggtccggaatgcacctatttcaaccttaccagctgagatggtgcgatctgggtcaatgacaaccgcaagaaaaggatccgagaatgattgctgtatatgctgtgtgctaacatctatgccactgagccagcagccatagcctggatgactgtggtaccaccccactgcattctctaactttccttgctctcgacatgcctggagataacgaaccatatattcatttgcctcatcttgggcattaacacgtgtctccgtgccttcta

SEQ ID NO: 42 - DNA, 534 bp, Artificial Sequence
  Synthetic
tctgcctggaatttgacaacgcatgtaggatttcattaagttgagtgctaaatcccatttcgaaaagtcgatctgcttcatcaaataccacatacttgaccgaggaaaggtctaatgacatttcaatcttaaggtgtaagaagcgacctggcgttgcaataataatatcagggttggctgccataaatctgaattgatcttcaagactatctccccctacaagaagaacgcatttgagatcagtgctccgagaaaattccttaacgactttcaaagtctgcaaggcaagctctcgagatggggatagaatcagagctctagcaccaactcgagcactatgcgccttcaacatttgaatcatcggaataacaaaagccgctgtctttcctgaaccggttctagccattcccacgacatcttgatgatcaagaatcagaggtattgtttttctctggattggagtcggaacattgaagccttttcttttgatggctctcaaaagatgagcatccaaacccatagattgaaaaccgg

SEQ ID NO: 43 - DNA, 1057 bp, Artificial Sequence
  Synthetic
actgaattcaatatccataactgccgcgacatgatctttgagaacattcaatgcccttgtcatctttcgcatatcaaatatgtatatattgtggtcttcatttgcaacggcaaaattgaaagcctccataggattccaagagatagcgttagatgcaaacctcaatattgttttagctaagggcattgatgtacgcaaatcatataatataatagatctgtcggttgctgtcgatgccaaaattgaggtttctatttgattaaaggagacagctgttattgtatccgtagcatttggccattttaatacttcaggttgcgcgttgtatttttcaacatcatatatagaaattaaatccgaagcagcagcgaaggagtttagtgacctatggtgtgatagactcgttagagcacttacacctagccatgtcgctaggggcattgctcccgaaggtgtgtgatatggatcatagagttttatataacgatcgctagcacaagttaaaagcttcttatcatttgtccagcacagtcccttaactatgttttcatgtgcagtagtattccaagtttcctctcgacttataagatcccacacctttactacgccatcaccactcccgctagcgaatctctgtaaggactgaggatctttagccatagtatagactccatcaacatgaccttttcctaactgagtaatgaaaggcgcagcaaacatcctttctaatttagtagcattcaaagcccgagtatattctctcgctctttcaaaaggatgtaaagcaggatccaagttgcgaggaactttttggacatcagagccagcttctaccaaagactggcggttgagtgctttaatcttcatttttggctatgtgagagcccatacatagatttgtgaggggaatttgatttctggacatatattcacgagattttgtatacaatactcagtataatgacgctgatgtattgatctaggtgaacaaaaaaattaggtgctttagatggattgggcccgtagatgcgaattcagatgaattggattggtcata

SEQ ID NO: 44 - DNA, 876 bp, Artificial Sequence
  Synthetic
ctggaaactaataaacgcaaaccctttagccattccagtttctctatctttggccaagaatactcttgtgacacgaccaaatcgttcaaacatatcacgtaactcttgctcctccgccatttcagatacattcgtaactctaagcgttgcatcatctcggtctcgatcatacttgccgccacccattcgatcacctccaccagctgcaccgcccgttcgtaagtgaggtggcacatatgaagcttttccagttccgacctcactagggccttcagtagtttcattaatactagttaaagcatctccgctgttttcttcaccaattggagccattgtatctttaaagggacatcgggctgtaaaatgctctccattacatatacgacatttaactttcttatcttttaatttgtctttcattattcctgcctctgttttttcatctttggcatcttttttccagttggcactcggtctgaaagttatattttcaccaatagatgtggttgagctatctggtccgggttgatctttagcagagagtccaaatttactccactgctttctctcggcaactctaggatttacaatttctttgtgtgtagtgaaacgaattcgtctggtatatttgatcttttttccatcttcatcgattcgataacttacgatagtttgagagccatctttattagttgttgtagttgtaggaggaagttgttcttcaatccggtcaacggaaagatcttcatcgtcggcccagtcagcgcgaacagattgtttagacatttttcaaaatattttaattaaatacttgcaaatggaaagcttgtaaattcaagcaagtatctggttcccttcagaaaaagggcattcata

SEQ ID NO: 45 - DNA, 515 bp, Artificial Sequence
  Synthetic
tggagtattactaggaacatcaatgagggcgcgggtttcatgagttccaatttgatagagtaatacgggagagttgtcaccgagaatcacaattccgtgatttggagatggaatagggcaatctatcagctctaaagcatagaatttgctttttacgatgggtgacttgtctatatactgctttcggaatttagatgcatatccatcggcgataattgtgagatctcccaaatagtagtcggcttctcttttgcctgttttatcattcattgtctctgaccttacgccaattacagtttgggtttgaggattcgtaatagtctctgtaaccagcgtttcaacaattttgatgttcgggttctgggagcagcatctacggagctgagatattagtctaccatggtgaaaagctcgtccttccggattaccgcccttaatgtttgtatatccatgagcactcgcattatcggtatctgccttgggataaggtattttcacgccagtgccataataaa

SEQ ID NO: 46 - DNA, 498 bp, Artificial Sequence
  Synthetic
attgcacatcgagatataaaacccgaaaatatacttctcatgaatagaactcctactattaaattaggtgattttggcttggccaagatcgttggtgaggaatcattcacaacaagcttatgtggaacacccagttatgttgcaccagagatccttgaagactcagataatcggcgttacaatcgagctgttgatatttgggctctaggtgttgttctttacatttgcctctgtggcttcccgccattctctgatgaattgaccagtaatgattatccttacactcttgtccagcagattaaaattggtcagttcgacttcccatcgccatattgggataatataggagactcagctcttgacctcattgacaaaatgttaacagtagatgttaacaaacgcattaatattgatcaatgtcttgaacatccatggctaactcaaagagaatcaacgactttgccaggtgattactctgaagttcttgacgaacttgcc

SEQ ID NO: 47 - DNA, 443 bp, Artificial Sequence
  Synthetic
taaaggaattgaaggaggaaaatttgatgatggattgataacagacggtacttgcccatttatacgaggtggtagctgataatttgaaaagtgacctaattgattatgtgaagattccatcggggccctgtacgtaaagtggcctgctatctttgagagaccattttgataaggagtttgttgcagacctagataagattgaggaggcggagtagctctcctttttttctctttttcaatagatataccgtcaacgattccccaagtccagccttttccatccttttcaactttgcggaaagcatggtgttgtgatagattgtgacgaacactactttgccagcctaaggtttgagttttaaatctgaaatatgggtatttcctgtatatagctcggtagatgtcgggcaatcccagctgttgagtaggcgcattcgaaagag

SEQ ID NO: 48 - DNA, 580 bp, Artificial Sequence
  Synthetic
tcacaggtgttccgggacgcttatactcaggaggggcaggggaaattaggacagagtcttttgatggctcatttgagttgatttcttcaggtgagattgttcgtatgccaggggatttttcgttagctttctccgtaattttttcatgcggtgacgaaatcagtccagcccgatgcaagtagtagttggctatcttaagacatccatcttcctgtggcaagacaaacatcatctctactcctccaatttcaataatttcgccactagagagtgaaatagaatcaccgcgtttaagaggatgattatttactttgatcccgttacgtccgtgaacagagatgttccatgactctgtgtcagagtcgaatgagatttctgcatgtattcgggatactgtcttactcggaccaagatcaatatgtactgtgttatcgtcttcttggtatgggtcgccgactaccccatctggttctgagggagtttgatgtgcgactgatccttcgggaggacgaccgatattattcttaagtcttttcacgtagaaagtccagtcctttccagctagcttcgcataggcttg

SEQ ID NO: 49 - DNA, 451 bp, Artificial Sequence
  Synthetic
ctccgatctgctacctgaattttgatctccacgaatgtattttctccagaatttcttaatgggctcatacacactaaactgaactgctgcatgactattgccaagcaggctgatgccagcgcccctataaaagcctttcactccttctttctgatatatcagtttgacgccttgccacatattttcgtaggctccgtttttccctctgtcagaactgaccatgcgcgtctttagaacccatattggattggtggtgagtgaaaccatcattcctgagactgccgatgcaatgaaaaaatcaaatggcttcagtaaatctcgttgtttgcttgctttgcatgtatcgtttggagcagcaagatctctagccatgaaaatacgatatctgataatttggccttcaataacagacttgaagccgagaaaaattgaccaactccctgaatttccc

SEQ ID NO: 50 - DNA, 728 bp, Artificial Sequence
  Synthetic
caacagtcttagtatagccctggcccaagagaagttctggagctaaatattcaggagtaccacagaatgtatttgttcggtcttcatctttcatttccattttacatagtccaaagtcgcataatgcaatatggccagaataatcaagaagaatattctcgggttttaaatctcgatagatcacattaaatccatgtaggcattccaaagcacaaagtaattctgcagtataaaatctcgatcgatttatatcgaaccgctgttctttttgcaagtgatggaaaagctctcccccattaacaaaagctaaaacaagataaagcttttcaggagactgaaatgtaaattttaaggggacaataaaaggattgttaatttgagagaggactgatcgttctgctagagtgtgtgcaacttctgagcgagaaataatatgggcttttcgtattgttttaagagcgtagattctttgagtatctttttttttaacttgcatgacttttccaaagctaccctttccaacaactttcaagagttcaaaatcttcaattttaaatgactgtgtttttgtttctcgataatctactccgatccgaattttaccagaaccatatgaaatatccagccattcagcaccagactgaccaagagacttctcgctcttcacccactctgaagcagccttttctctgtctttcttacttagcttaggatcctcgacatatttg

SEQ ID NO: 51 - DNA, 1103 bp, Artificial Sequence
  Synthetic
aaaattatgacaatagaccatttttaaaactctcaaatacaaataaaaattaccttttcatcaatagtacaggtaaattctcaaatatattgagaggacccaccgagatatggagtatcaactcgtaacccaactcgttacactaattagggagtatgaaaattttttagggtagaaagcttaggtcaacggtgggtaatacgctttttgtgttgcattgcatcactgggtgaattgaatttggctctaaaacagaactctacgctctcgccatgactccccacgctcgaattatgttatcagtgtatccagcaaataaagtttggccgtcagcgctccaagctaaggacacacattcaggctcgtggcttttcttgccgacagcctggaaatctggccttaattcatccactttcgacttcttttcaaggtcaaagattatgatagagctggaagttgcggcacatagccagtatctgttaggcgaaaaaacaagcgcatggatcaaatcaccagcattgagagaatataaatgcttagactcatttagatcccacaacatagtagtcccatctttcccacctgatgcgcagagagaaccgtccggcgagatggtgacagtatttatgtaaccattgtggccaatatggtcagtctgtagtttacaagaggataattcccagaccttcacaagtttgtcccagctactgctgacaatgactggattttgtggatttgggctgaatcgtacacaagatacccaatcattatgacctttttcagtaatggtgaacttgcaatcacctagagtattccagagcttaattgttcgatcacgagagcccgagacaatttgcctgttgtcagcggaaaaagaaacagaaagaacatcatttgtgtggccgacaaatctccttgttgtggttcctgttgcaagctcccagagtcggagagttttatcccaagaagcagatagagcataagcaccatcagaagaaattacacagtcggaaactatatgagagtggccatgaagtgatcgctttgggtaaccgtaggaagactcgtcacgggtgagattccaaataattaaagtcttatcg

SEQ ID NO: 52 - DNA, 616 bp, Artificial Sequence
  Synthetic
ttcgaaccccgatgacaaggggagatccttttcttgccgcaattacttcatggggataatggactgattttagtagaagtccaaatgctccttgcagctccttgatgacggccttagctaagtccgtaaaagtaattgttgggtgctggtcatatatatacttagcaagcttggcaatacactcagtatcagtctctgtctcaaatttatggccctttgagataagtagggttttgagctctttatagtttattatgattccattatgaacaacactgaactgccatttggggtcactacgatgaggatggcaattcaatcttgatggagggccatgggtggcccatctagtatgtgcaataccagcatgggagtcaaaaactttggagttatctagttgcgactcctggacaagttgctttaattttgcaacctttccaacttctttgaacgcaaaaacttcatctttttcatccccgtcaattgcgagcccggcactgtcgtagccacggtattccaagcgagagagaccgttgacaagtgtttcaagaatgtgtttgcgatccttttcaatgagataattaatatagccaaagatgccacacatgctgggcag

SEQ ID NO: 53 - DNA, 1293 bp, Artificial Sequence
  Synthetic
ccagggtcaagaaatttagtcaattcaagagaggcagaaagttattcactgatgttactcttaagatggttcaattatattttgaacttgatttttaatgaggatttggtccggtgtaaaattccttagggttaagtaaaaacatacattgactagttatcatgatcattcgctgaaaatttcaagtcgaatcttcttagtggtggctctatataacacctacgtgtgcggcttaagtagttgaagataaaattttattgatttaattttatttttcattcttttgagcgaataaagacaggatttctttcgagaggcacttgttctcaaaattatttttggccgtggcacagaggatttttttttttcatcctagtagataatcaaattaggtagctttggcagctttggccgctctaagcaccttctttctttgagcaatcatgtgggtgaataatatatatgaacctggaatgtagatcaaccgagttatttggagaaaccaagcaaaattctggtgaagtgtgccagcaggtgcaatggctttcgagagtaaccaacattcgctactaatgccaagcgggtaaagaacgtaaaaagtattatagcggagccacataattatttttgggttatagccactgagattgaagacgaagtatgaatatcggataacttcggtcacactccaagcaatcaacatactggagtagcctggactcctggcaacgaagggaaatggatcaacaaccacccaaacaagcagaaggcgacttgcaacctgcattgctgtagtactgatgggcgcgcgaacaataccaacggcggagtgtataacttcaagtagcgctaatgactgtgtcatttgagtgtatttgcccacgccatcatagactcgagggaagccggctaatggaataagcatcagcacccggcccaacacaccaagccaaaggatggaggacacaaagttatagaggataagatattttgttctccatgagcttgtggttgaaggcttctgccccatcgtagaatgcttctcgttaaccgcagatgacatacttcagatacactcaagtgaaaggaagtaagtacacaaatgaatggaaataatagctggtctacacaaatagtgcggttgaacaaaatgccccctttatgatgggaagaacctttggggtcagggtagtcagtcttagggatacgcctctagccattatgataggctcaaacgctcaagggacgaaagttgatccgcaaaccggcaaagaacggttttttacgccgcgg

SEQ ID NO: 54 - DNA, 676 bp, Artificial Sequence
  Synthetic
tttgggtgctgcttcagcaaggtcaattagcgagaggagggctcgagacaactcttctgattcctgtttctcttttattggtggtagaatgttcaaaacctctgatataagttcatagtatttttgcttggattttttgttgagactcctgaagaatgaagcgaaagcttccatagcggccagtcggactgtcacgtcatcatccttaaatcccttggtaaaagcagaaagaacagtatcttcatgctgcttttcgattattctaggagttgttgagaagattctataggcaatctcacgttggcccatcacttgcgacatactgagtgtaaagagaacacctagaatttcgggccattgcaacttatcatcggagtactgcctagcgacttctgcgactgcatcacctatcttatttcttgtagacgtttcggtttcagagctaagggcttcaagaagtttttgtctgataatatgtccttgttctgtcggcaaagagataaatgtttccactgactgattattttgtaattttcgagtctttgaagctatccgtctgaagatgactgcagcaaaagagcgtttcgcaggatcgtttgagccctgaatttgttccaccaggccaatcaagagcatctctggtttaagcaacgtccaattattcgttaaatgtgcc

SEQ ID NO: 55 - DNA, 1185 bp, Artificial Sequence
  Synthetic
tcccaatattagtctctcccatgcctcagagcattcatgaacgatatcagtggcatatttcttgttcttacactctcctgtaaaagcgaattgattttcgggctttccatctgggatcttgtaaatacgaaaccattcattagttgctcttagaagcccaggtaaatgtctttcaacatcttcaatatcgttgagtttagaagccagtgggtcgttaacatcaatgacgattactttccaatctgtctcctcttcatcaagaagtgccatcacgcctagaactttgacttgtttgatctggcccggatatccaactaattctccgatctcacagacatctagaggatcattgtcaccttttgctttggtttctggatgaataacgttggggtcttcccaggtttgaggaaatgccccataattccaaagatagcctttgtggggaaaacaattgcgaacaaatcgaagtttcccttttttggtatcctgttttatcggattaagggcttgctccttgcagatttccaattttgcattagtccatctagggatttccacaatcatgtttagtattgtgccctcaggattagcgtagagtggtatatcatgaaaaggtgatatcggatttccatctctttctatatatattcgataatcaagagtattgggctgagcaatcttgcgtatggagtattgagaagccatgatgttagtttttttatgaaaaactcgaaggtgatttgctagttgagtggaacgtgatatagcctgagataaaggcgccagggttgacgagacttggatagaaatgagttaagctgttagtattccaaggcgctgtggtttatcattggaaacgggaatgcacattagtatcataacaatgcctgtctgtttaattgtcagtcagtcagtcagttagtcacgtggggcagagagcaagctgcgcgttcacagctagctgacaacatggagcctgctttaatttaattctttgtttgggtgatcatagccggctggagatgggagaaaaacaaataaaaattcccaaacattctgcccctgggatggaaggaaatttccaccttatgactgagaccttccacgccgatcacttggcaaatgccctaataccagtgttagaacactcgctgcggggcaagacctcaccccaatttggatccg

SEQ ID NO: 56 - DNA, 1930 bp, Artificial Sequence
  Synthetic
tgaactgccaggaactaaagcttgactgcgatcacgaattttacttggatcaacttttttcaagcagccaattcccccggctttctgaataccagccaatagatttgatcgatcacctacatgtggcaaagaagtattttcaattaagtgacttgttccgcagtttgaatgagattttagtgcagcaggaaatgtagaagatcccatatcagtttgcaatactggagccggaggtggaggaggcggcggcggcggcgggataggagatgtaaaacttaccggctcatttactggtgattgagcttgagatagtggtggtggtggtggcggcggtggtggtggcggcggcggcgatggcggtgatgctcgagatatcgggaggggtggcggtaatgaggaaggctcttgagctgctatgagagatggtgatgattgtgcctgatgtactggaagtaatggtagtgatgatgtttgagtaacacgaagagatgttggcgatggagctggagaaactgagggattttttggtatttgagagactgtgaaagattgaggttgtggactatttggctctctattcttttcacagtctcgagtagttatttgaacactaggacgtaacgaggaaggaggcaaaggaggtgttgctgatgcagatactatcggaatttttggaggtaattggggaggagggagatgctcacttttagcaagaggggttgtgacttgggaagaacttgtatgaaaaacacgagttaaaggtggtattgtttcacgtggtggtattaaaggccccgcacgatgtgaaataaaagatccagtgtttttctcacctgaaaaaggtggtggtacgttgaatttagagacgcccgattccgaattttctttagaattttttggagggcgaggtggaggacgtgggctttgattagattgtgttgaaatccgtactttaggaacttgctgattgggtatatgtgctagttttccagcatcgggaagaggaggaggagcagcaaatctttgagaaagagaagtattgagcggagatgagtctcttggaggagttggctctctatgaagatcaacctttacagcagttcgtcttgctggaggaggtgctgggggtgtacctctgccgcgtccagaggcagaactaggcgctaaattttgtggtggaggaggcggagatctaattctctgatttttgataacatttgtagacgagtgaatttggtctacttttggtgctttgatataatctgctataaaatcttgattttctcttatcaaatcatccgttatgcccaagcttttcaagtcatcaccccaattctctctccagtttggatcaatagcgtacaaagctgtaaaatcagaatcgtctttcgttttgctaggttctgaatattcttttttgtgggtaggtgatagactaaagcttggagattctggaggtgtgggttggattgaagaagcagatgaatgcctgtatcctccaaagaatccgcccagtataccatgtctaaagccagttcctccaaccggcacagaaatccccccaaaaagctttgctttagttgctttgcttgcatttttttccctatcattcattttcttaaggaatgttttggcttctttctcatcaacaaatgacagacccgcaagacactcttcgatctcgaatgtgtggaagaaagttcgatcttgagaataattccaggtgtcgtagatttcttgatcccagagtataccacgattttgtggcgacgtgtctacgagttttagccaaaatgtgtttccaactagatcattagcgagcacaatcacgccctggtatccagtatttgtccatttattgcgatctggataagctatataaagccgagcagctgcaattgcctgtattttgttacttgcttttggtacc

SEQ ID NO: 57 - DNA, 751 bp, Artificial Sequence
  Synthetic
ccagcgtatggtagcatgcctataactgtcacagaaaatccacgataaaagtttgcaaacttatttctttgtgatatcttttggagagggttttttacagcctctttgggaaatcttatggattgaggcgaaggcggaacttcattatatatgattttgcaaatgtgtgaaaagcttgagctcgcacctttctttgtttcaaaagctagccgaacccttatgacttctaagggatatgtgaagaaaacactagcgacgcctgctaaactgccacttaacaatcttcgtaatgatgtttcttgcgtaggtgatgatataagaaatgatcgtatttgctcgtaggttaaaaacttgatcgcagcataaggaaatatccgaattatagtggcagaatggccacgaaatagaccactaattccatcagtagctttgatttgccgtatagcagtcacaacgccgagccagctcccagcgtatctggaaaattgtggattagaagattggaataatatcttcacacgatctaaaggtgccactatagtttttgccgcactccctgctagtcctccagctaatcctgaccgccatatgaatcccaaagattgcttttcatgagtttgggattttgatgaatcttttttatttttcgtagaagggtatactgcaatattactttcatataaatgcgccgcctcgtcccttttgaacgcatgaggcgatgtggaaacacttaatgcgcgacctgcgctca

SEQ ID NO: 58 - DNA, 2035 bp, Artificial Sequence
  Synthetic
taggccattagttcttatttgctttggcaccaaatgttggagtgctatgtgctgtttttctagtgtagtatatccagaaatatttatcatttccattctgtctaagagtggtggtgaaatagtatccagactatttgcagtagcgataaacagaactttgctaaggtctactggaatattgacgtagtggtctgtaaaactgtgattctgctctggatcgaggacttcgagcattgcagcgctaggatcaccttggaaattagaactcccaattttatcaatttcatctaaaagaaaaacgggattgcacactccaactttcttaagcccttgaattatgaggcctggcatagctgcaacgtaagtacgacgatgtcccctaatttcagcctcatcccgaacaccaccaagagaaattcgatgaaatttacgaccaagtgctgttgcaacagattttgcgaggcttgttttacctacacctggaggaccaacgagtagcaagataggcgatttatcaaccattctctgactttttaagatttctagtttttcatgtgctctttcttcagatgccttcttaatcttgatgtcaatgtcttgatttattgattgctttagtttgagaaccgctaaatattcaaggagtcttttcttgactttctccagaccataatgatcatcatcaaattgcttacgggcatttcttaatgtatcaacaccaagtcggtcctcggtcattttagtccaaggtatttccgataagttctccaaataatttctcgttacctgatactctgcttgagctggtgacattttctttaaccgctttagttctcggtttgtaatctttaatgcttcaggcgtcagcttcgcttcgtcaagcttcttttttaattcatctaaatcattaatttcttgatcatcttcggatattcctaggccaggtggaattggtaagccatttatgagacgcgatctaccacgttggttcccaaactgatctaaatcaatattggcgggtagattactcgttgagacagcactaatgcttagattattcttaatgttactaatctgccgcttaacaatccttatagccttttcgagtcgttctttaacttctactgcagataataccaagagtttttcctcgatcgaagcttcaacaatattcgtcataaaatctgccagtgccccagcttcagttacagtttttcttgaaatgtagtgatataaccggcgtgatagaactggtgataaagaagaaaagctagtagaccggggtaaaagggatgaaattcttattattgttaaaagttctcttgataattgctttaattgcgtgaacaggacctccaaagccgtatcttcgatagatattacaggatcatattcatatattacatcagcctcaaaaaatgggctatgccttgtcaatttttcgatcttgactcttgctattccttcaactagtaacgcaaactcccccgtacctcgaccctccacacctgagatcttcgcagctacaccgtagccaaatagggattcactagatatataagaagggaagttttctatcttatcggggtgtgctaaagtccgatcatctagtaatatcattttctggccatatcgagtgagaagaggagagcggaggggtacacatgcaatgtggatgttatctagacgttgtgcatgatttttcgatgctgtacggctgtagattttggctaagagtgagggtatgtcggacggattgcttgctacaggtattctcagaacaacacctgggagaagtacggtgtctctggttagtgggataagggggagatttgctgttttgacagtcgtcatcgtatagtttaagtgaaatttatatatatatatatatgtgtgtatatatatatatataaatatatatataacgactggtaaaagcggggtgacttttgggttgtttaagtaggtggtgatgaagtgtgagagaataatgcctccagtcgtcccgccagcctccactagtggcacgatgaga

SEQ ID NO: 59 - DNA, 944 bp, Artificial Sequence
  Synthetic
cgataacccagcaaagattggtgtatgtggtcagaaagggacggagcttcacgggacacacatccgacgcataggcacaggttagtgtttgaaaaacaccaaaaggaataccacaaagaatctccccaataagcaacatgacgatatttttagaaaaaaagaggatgttgataaagcagataatagctccgagcgagtatatgagggtctttcggtatccgaatcgctcaatagcataagcatttaaatgtaagccaataatttcaccagccagacatccatttgaaaggcctgcttgccattttgctggaatttcgtactttccattcggccccatcgaaccatactttttgcaaaaagatggcatcgcatagaattgagcaagcaagagattatcgtaaccttccataataataccagttgagatagcaacactataaacagcagctggccaccacaattttagagcttcgttgacagtcatattcttttcaagctcttccgcacgatgggcaccctgagtggtatagtactgactcttttccaaagaaggagctcggccaatgtcctcctcatgcttggcagtagtttcaagaatggacttgtcgataatagacattttgagagttgagaagtcaaaaaaattttgaagtaaagatcagactaaaggtgagtttggggatttaaaaaaagaatattagggtaaggttatgattgagttcacaagggaataggttttctagaaagagcatgaaggaaagacataaaacctgagagtgatatttggataattttgaattccatcgtcaacagcttcgggagacaagtctttatagaattctgatcattttcagaatcacttcccatcttttccctccacccccctcccccttccctccatccctccctcaaaaaaacccacgatgaccactactcatagtttg

SEQ ID NO: 60 - DNA, 533 bp, Artificial Sequence
  Synthetic
ctttgagccaaaataagaaacgacacgtagctttggagcccattttttaatttctcgacgccaattaaggcaagtcgaattaggagctacaactaaaaagggccaacatttcgagtgatttttgacaattgctacgataaaggcaataatttgtattgtctttcctaagcccatctcatctgctagaataacatttttcttttgatggaagttataaagtagccaatttagaccttccatttgatattgcatcatctttcctcctgtgagttgtagaggttgctctttcatctcaactcttcttgaaaaatttaattttcggaacatctgtaagcgatggtccatagctgaagttgaggattgcctaaagtattttccatcaataaattcattataggcggtaataaagctttgatatctttcgatattctcaatttttgggggctccatccatactgcttcatcataagcaagacctttgaattttacaaagacttcagtgatcatattagcagcagccttgtctatcttct

SEQ ID NO: 61 - DNA, 765 bp, Artificial Sequence
  Synthetic
cgggtccgtcgctgttcctcttgtctgtaatatagtttttactacatccataggggtagtaagtgccgccgcaaagccaccagctaaagctccagctgagcaatgagtaagtggatcgtaagcctttgatgggttcagaaatgtagatacagattcgtatgcgagaagttgaagtgctgtaaatggtacagtcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaatgcgcatgccccacttgtaactatgtagcttcagtaagtgctcaatatcaaggataaattggcgatgtagtcatatatgtctgattccttaatcaaaattcttaatacagacctgctgcaataggatgatgagctcctgtttgattacctcccatgagatgtttgacagcttcataggttgcaaaatagactgcatgagcagggcctgcgcccacaacaacacttgacatgcctcgccataaacttaaagctccctctcctgtaattattcgatatccgccctggaaaattccattataaatcgccgagggtgttgggttaaggatttgcattcgggtctttattgcatctaccggatacatcaaggcgtgttcagatatgccag

SEQ ID NO: 62 - DNA, 850 bp, Artificial Sequence
  Synthetic
tgatgaacatcgtgatgctcagctccagcccaaaaaggaaggaaatgatgtaagctccatgggaattcataacctgagtgagcatcaatagcttggaatagtcgacagataatccaacaatacatcgtaactaagtgaagattgccagttatcagacaccatacagttggcattaagactgttcctgcgccaagaaccattgtttctattggtgaagcatattcagctgctagtccgaagggtgcagagtaatgatgatgtattttatgaatatgtttgtagaaaggaccccaatgaaataatcgatgcatccaataatgccacgtatcttccaacacgaaaaagaaagcaatctgaagacacatagtttttaatgatggaaatgggacaccaacatccataccacaagcctttgtcaatggatgaaaaagccaaatttgaggcagctcgacagtgaaatgacttattaagaccagttttgtacattcccattgttctttggcagttggaattttctgaccctgaattttatatttgttgaaatatggtatatatcctatgatcacccatggaatacttcggccaaaataaacaagttcatgcataacaaaactcataataccagtggcgagagtatcattttgcatatattcgtaccaggacatccataagcgttccaaaatattgagatttaaagcattctgagaaatttctttatagatttccaagtaggtagttgggtttatatggacagtcgcattagtcgcgaagtccatagtgctaagatgcaatagagatgggaactccaaaggatttttaatgcttttgatagtgagcaaagaagttgcct

SEQ ID NO: 63 - DNA, 529 bp, Artificial Sequence
  Synthetic
gttgaattcttgctgtaatttctcattcgcgtagttgatacagaattgctcgaatgagttttttgcaaagtgttcgaatccataaatatctaaaactcctataaatgacttgacacggcttaagacttcttcagcagccaacgcataattgatattttcaacaagccagtcaaaaagacttgaataaacaaatttagcgaccgaatctcgaacaacaatggcttgctgttggcttaagctactaacgactttatctccccgggtaattaattgcttcttgactgtccatctagcaaattccaccggatcaatgcccaaaattgaagcagcaatctctagagaaggctcattaggagtaagtgaagattcatttcttgtggcagtaatcttaacatttccaagatgtagtaatgctgcaagtattttaaatatttcggtctgctgatcctgtttgactccaattgttgctagggactttttgagtgcttcgaattcggctttatcatcaactccatctattgaaggtgag

SEQ ID NO: 64 - DNA, 482 bp, Artificial Sequence
  Synthetic
tgtagctcctcgtattccacttctcatagcgactatgaagaatccatcaacttcaactttacaaaaagcaatacatgcactttcacaaactacattcgtcgcggaagtgacatctcctgtgttagctctccttacgcctttactagaaagatctctcaacactccatcaaccactcaggaagtccttcgacagacagtggtcgttgttgagaatctaactaggctagtgcatgatcctgttgaagcacgaatatttttgccaaagctgaaacctggaattagaggtgtaatagatcgcgcttcactaccagaagttcgccaattggcacagagtgcgctaactgttattgataaggctatgggcgattataatggtgctactgctgctccgggtatcatatcccatgtcactccacacgaggtttctctcattttagaaactcatgtaaaaaaaacaagctctatagttgatactgatgccg

SEQ ID NO: 65 - DNA, 914 bp, Artificial Sequence
  Synthetic
gatatatatctttgacaactgtttggaaagctctgtgggagttaaaaggtcaagttttcgaaatagtgaatcctgtggttcatttagaccattatagcgagttacatcaattagaataccaaaatttcgatgccacatacgacttgcagtttttaaaaatccaaataataacagctcaaaatctgtagtttctgcgtcaaagttgcgaagtattatacagatcattggaagaccatctttactttcgccaccatcataaagtgcacgagttgatacaagggactcagtattccttccagaattttggagcataaaatgttgaaatcgtgaatatgatacaggactatttaaggagattactgggcggttccaggacacatccattggtggtggtccaagattcgttatgagcctccaaagcgcttcagatattgatatctccactacaccagaatctgtcgacggggctattgctcccttcctctccagaagtcctactttttgtcgaacatgatcccagttatcatataagaatctatgcaaagcaacgcatgacccaaagtcaaaagattcagtctcgatttcagtctctactgcactaggtgagaccgatatctcacggagaaacgttgtgaccctatatatattctgagtgagaaaatcattaagtggaaacatgtatggttctttagcaccaaatagaacattgttggcaagattttgaactatttttgcaataagaagaagtccgcgtctcatttcttttgaaggaggtaaatctacaagaccttcggcgtcgggagctacaatagctgggcaaaaaaatcgcagaaaaatgaacgctccgacagccgtgaatttggcctcagggaagcgcttcatcacagcagaggatattatgctacatatttttc

SEQ ID NO: 66 - DNA, 702 bp, Artificial Sequence
  Synthetic
cggccaattatttttctcgactcccgcgggagaagacgtaatagtcgccatggtccttttataacttctggctttttttgtgtatcaacggatggttggtcattagtttttagatctggtgtagacgaagagtctatcttttttgaaatagacggtggactttcaggagtaggaactaaatctgttgttgatttatacgataaaagattccgctctgttcccatagatggtgcagaagaaaaaagcttataggaattatctgtcatgcgtggtaacttccatgggaatctccgtaaagtcatgcagcagtaaataatcgcgagtgaccagatatctgctggctgtgggtcatattttctctcttcgtaaacttcaggagcgagatacggatccgatcctacaataccacttgctttagttataccagattcaaaaggatatttgaagacactcgcactcccaaaatctattatcttcatgataccatgctcattgaccactacgttgtctagctttagatctcgatgcgcaaggcccatacaatgaaggtatgtgaccgcgtttaaaatttgtaaaaacgaacaagttatttcatttttcgacatctttccggtcataactattgcgaaaagatcatatggagcgtattccataacctcgtaccatttttctttttcgcaaacaatatcaagtgtttcgatt

SEQ ID NO: 67 - DNA, 3044 bp, Artificial Sequence
  Synthetic
tcagagccttgggaactagagcaaaacggcttagtccagtctcatctcgttcatgctgtatagcaacctttgataaatgcattattatattttccatttgtgtgtcagcccgcgatcgcttaaatcggccaaggttatccaaccactgagacttgttcaatacatgatacacaatagcaatcactatcgtgacagcaatagaatagccccagacaacaataatagtgacaatggaggttcttccgtcagtagataaaagggagtttaatgtggcaggatctgaaggctcaccagcaccgccagttaaccaaccaaagagacagaagagagttgcaagtacatcaacaccgaatatagcagcaacgagtgcaaatgcaggataagtctcatctcctctggtgacaaagatgagccagttttcggtgagagaaatttgaaggaataacattccctggatagatccaaagttatcaatcatgccaccattaggtaagaaaagcgagccacgtaatacccatgttccaagagcaagcaatatgccaagaacaacagagataatccagattttaggtaattgccactcaacaggtcgaatctcaaagtgagcgttgtcgtatgcaactgcaattgtggctaaatcggcaaaaagtgcaaggaagacaattaaatcaacccggacagtttcgttaataatgatcatagaggttacaagatagatttctaagtgtaaacataatgcaatacgatattggatgtatgctttcattcgctggaaaatttgacgagcaatcttgatggctgacacaatagttgagagtccaggggcaaggaaaacaatgtcggatgcagcttgagcagcctcagtagctccttcgacagctattccacaatcagactttttcaaagaaggtgcatcattaactccatctccagtcattgcagtcaagtgaccacgctgttgtaacatttccacaacctgatatttgtgctctgggaaaacttctgcaaatccatctgctttctctacaaggtcatgctgtgtagtgcctgataagccaccgtgaattaatctttccgagttgtagactttggttccaagagccaacattttgcaagtttccttcgcaatagcaatagcatctccagtcaacatcttaacagaaagaccaagtacttgggcctcagcaattgttgaagctgtatcttcacggggaggatcaaacataggtagcattccaagtagctgccaatctccatcaccttcttttacagctactccgagcgaacggaatccacgacgagcaaattcggtaaccttagctttgtacatatccgaaacttcttttgaacagtttgaaaggttgagtatggctttgggagcaccctttgcgcaagtatatgtcacgccgtccttgacaacaacagcagtgatacgtttagagacagggtcaaagggagtgaatttttcagttctccagccttgagaaagaatttctttagctcttggatatctcttgagagtgagtatggtgaccttatcaattggatcgagagatttcacgttgtgagaggaggcaagagcagcgacggccatcatccagtttacgtcaacaccttcagctacgaatgggtcacgaatagaaagttgattggcggttaaggtaccagtcttgtcagagcaaagaacgtcaactccagcgagagattcaatagctgttaatttttgtacaatagctttttcttttgcgagataggcagctccaactgcaagcgtagtggttgtaacaactggcagtccaacggggacaccaacaataagaaggattaaagcgtaatgaagtaaattattggatgagttttgtggtgtggcaatagacaaatgatggaagaagccaccaatccatgatgcaagaatgaaagcaacaacaagaacgagcaatgccgtaccaatggagttcataatagctttgaaatgaccttggtcctgggcaccagacactaaagatgcagttcggccgacaaaagacattttagcagaatgagtgacaatggcgtatgcctttcccctcttacatccagtggtatagtatataacatctgcgacatacttgtcaacggcaagtgattcaccagtcattgcggattgatcaatagctaataatgcgtatccagatccatgcttttcaccaatttcatcatcatcatctttctcgttattagattcaccagcttgggcttcaagttcacgttggtattcagcccaaccatttggattatcgtaggcggatataatgcggcaatcagcaggaacgacatttccatcttcaacaataacaatatcgcctggaactagttcacgggccttaatttcaacttcgtgaccatctcgaatgaccgtggttcggagagcaatatctcctttgagagaggcaacaacgtctgcagcttgtttttcttgataccaaccgacaatagcgttaagcattaaaataccaataatcacaccaaagtcaatccaatcccgcagacctgccgctaggagaacggccaattccattacatatagaattgggcctctaaaataagagacaaaagtcaggaacatattttctttctcagtcgtgagttcattaaaccctattttcttccttcgtatttcgacttctgtggtcgttaatccaagcttccagtcggtctgtaaccattcgggaggagtttcgtaaaggccatcaactgtcgcagctttcttgccgaattgataccattttttcttgacaggtagatcgtcgagaatggaggcgccagaagttgacatacgacggccatctttgaagttggaaatgtaccggaccaaattgccgtactcacccaacttctcgtcttcctcgtaggtgttggcaccgttctgggccatggtgaatttgggattaataatttacaattaaaatttcgggacgtctgccggctattaaagacaagaaaagagaggttaaatacagaaagaaatgtctctcgacaaaaagatgtcggttgtgcaactcgac

SEQ ID NO: 68 - DNA, 586 bp, Artificial Sequence
  Synthetic
cggagaagatcaagtaatcttgttcctgtgtacttccgttgtttaccaagactttctacaaagtcttttccaagcactttgaggaagtcgttaccaaaaatctgttgcgcatagccctcaagttcttgaagagcttttgatggaggatcgcgtttctctttctcaaattgatctgaaacatcacagagaaagtttagcctttttatgggcgaccaaaagaagggatgagccatgacttgatgagcttgcggtcggcactttgggtctgaatcaagcatgctgcctataagttctttggcttcatacgcatagttacctagaatctcaaggggattaaggtcatacattcctttcctaatatttacttctctcataaagcggtcgccacaatcaaaagggtgattacctctggtgagaacataaaaaaagataaggcctagggaaaaaatatcgatcgcccgagtggcacgtggattgagtaaagatccatgggttagtagcttagagtcggagttgttctccgcacatatatcagctaaatcagattcttcatcttttacgatttcacttaggagtaattctggtg

SEQ ID NO: 69 - DNA, 552 bp, Artificial Sequence
  Synthetic
ttctttgttagacgtatttgattggtaagcccaattaacgcggatttctgcttgatgaacacgtctgccattcaatgtttgcatcgctcgctcggcagatcctggatcatcatactcaacaaaaccataattaaatcccttagaagcacctacgttcttatcaggaataatcttgacgttttgcacatgaccagttgtttcgaatatttgtcgtaaaacatcctctgtaactcggggatctaaacctcctacatagagtgcccttttatttggctcaggagccgctctacgagaaaaagctccattattgttaggtgaaaccacagtcccgttctcacctataggcgatgtgatagctgtcgggattgggttcgtgttttgtggtatgatgacaggtgggagtggtggaggaggcatgtgttgtgagtttgtttggttatgactgttacggctattacgaccgtcgtatcctggtgcgcctgcagtcgtctgtggtggaggtgggagtgcggtccccgaatgaatgccattttccgacatagtgcctatttt

SEQ ID NO: 70 - DNA, 933 bp, Artificial Sequence
  Synthetic
ctccatagttgttgtttccataaccttggccaccacctccgccataattactttgatgtccattatagcctccaccaccgcccccacgacttccatagtccccacgatcatttccaccgtatccacctccaccgtaaccacggtttcctccatgtccagaacctccaccaccaccaccactgtaaccagaattaccgccttgacctcgctctgaagctttatctacacgaattgttctaccgtcgaagtcaacattgtccattgctgacatcgcgttgtcagcttccccttcactcgaataacgaatgaaaccaaagccacggctacgaccggtttcacgatctttaactacaacggcttcttcaacttgtccaaattcctcgaacttccttcgtaatgtgtgctcgtcagtgccccatgagagaccgccaataaagagtttaggcattctgtatgttaatttttatcctcgcgaacctggtataaagtcttaatctccgcgtgcatccttgaataaaatgtgacaacgccatcgagtttgagagggagagagaaagtggatacggaacagttaaagaaaagtacatcgggatataacaaaacctccgtgtagcatacaaatgaggggacgatgaatatatttgtttgcttggtgaacaggccggggaggattgggatgaagtaatgttagtacacactgtcagagaactaacgaacttctagtgagttgctcaagaagagcaaagtgctgcgtttatagggagacctgatgaactttattaattcggtttggaggagcaatttttataatggactggagtaaccgatcagtcaatttcgtgatagaactattcttccgcaaattgagacgcaaaagctctctgattgtgatgacaagagttttgcgggtctcaataaaggaattgatgtttg

SEQ ID NO: 71 - DNA, 619 bp, Artificial Sequence
  Synthetic
ccgagttaaagctacatttaaacgtcttgggtcacttaagaacccaattccttgatggtcatttgatcgaacacatgataaaacaatgaagtctttttcacgcccttgaaaagcatcgactgaagcaacttcaatttccctgtagttttcttttttaaaagtaccagtgttttgcatagagcttacaacgtaacttcgctgaccttcgtaaggtgtaataactccaatatcggcaggctgaacacctgctttgaaaaatcgggttactattttttcaacattagaagcctctgtgcgattaagatatgatgttcctgaagcagaaatctcttcatttccgagattagaccaaaacatcatcggtgtatctccaactggccaaggaaagtcaacttcatctctaagccgctcttgcatcgtcacaccattctggagagttccttcatagaacatatttgacggaaactctgataggcatggatgcatacgatactggatattgagtcgaatagggtgcatttccaacatgactagacgttcaaaaagtgactgatttaaacctgctttggcagcttttttattcataataactggtcctaattgttgatgatcaccaaca

SEQ ID NO: 72 - DNA, 1473 bp, Artificial Sequence
  Synthetic
gcttaattttactacttctcccttacagatgtccttgaactgattattatatggctctgttgaccattcgatctgaagccattaaattaagagcactccaataattaggtagtttaagtcaagatatgtaagctccaatgatagcgagaatcaacactcttgaggtagtatgactaaagaggttatacgtgtcaactcattcaatcttataacccaaacacagcaactccctattctctaatccaatttgtagacgttaattaaaaagaacgatcaagactccgaatctttcaaattcaacaaagacagaccgaccccgatgcaatctcattattcacaacactcacgacgccagtttgccttctcccaactttcatcaattctttatcacgtacgacagcttccacaacctcggaaaatactcgtcttacattctctcgtgtcttgctgcttacttcgcaccaaccaacggctcctctaatcttcgccttggcactagcttcctcgctgctcactcttcttaaccccaagctcgctttatcacatttacaaccaacaaggtaggtcacagctccaggtattgcatttgtctctacttcatcaaaccagcggtcaagagcgagaaaactttcgcgattggaaatgtcatacatcaaaagtattgcgtgtgcgtttcgataatatgaattagagagcgttcgaaaccgttcttgtcctgccgtatccaaaaggttaagtcgatatgccgtaccatgaactgaaattcttttaatctaagcacttattgttatcgccatggccgctcgattactattgattacttcaccttgaagtccacacctatcgtagtgaagtccacacctatcgtagccgtagatgattcactatcaaattgatcatcgcaatagcggataagtaatgctgatttacctgcacctgaaggtcctatcatcagaatctttagggttggaggcgactcatctgaagccatgctgtataagcaatacttctttccggaggcaaaggcgcactatagttaaaaaccgtggcgttggctatagaaaagcctgtctgcaggccttgtttaccggggtggcgaagaacaatccttgctcaaaatccgtgttacttttccattgtcaagttaagcatgtgttcatgacgattctcgacgaggaaacgcactgtatttatcagatctgtgaacaccattcccgggctgttcttccgaatatatgagtctaggaagctcggggaaggtgtttagctaccccacttgagaatggagattgttggttcgactgcgacagccttaaccatccacagtggagatgtgcagcctgtagggaaacttcctgagaaaatccagctttttggtttctatggacagatgtttgcgatcgaggaaatatattttgtgactaaagagcgaatttcctttgtaatgtgtaatgacggcatctacaaacgaag

SEQ ID NO: 73 - DNA, 805 bp, Artificial Sequence
  Synthetic
cgcgagtaagattatatgacgaccattcttcattagaaaacgatcgacttggggcttaatattttgaacgctttgtgcattagctttaagccatgcgacatctatttcaatgtcaaagtgtccaatattgcaaacaatagcatcgttaggcataacttcaaaatgttttcctactaaaatgtcacggcatcctgtagtagttacgaagatctgagcttgacttgcggccttttccattgtggtgacttggaagccagaaactgcagcttgtaaagcatttatagggtcaacctcagtaattagtacacgtgcacccataccctgaagagctaatgcacacccttttccaacatcaccaaaaccagcaacaacggcaatttttccagcaatcataacatcggtggctcgtttaataccatcgatcaaagactcgcggcagccatagagattgtcaaacttagactttgtgacagaatcattgacgttaaccgcaggcacgagcaaagtattgttttttaacattttatataaatggtgaactccagtagtggtttcctcagatacaccaaagcaaccttttaacatttctggatactttttgtgaacgagggcagtaaggtcaccaccgtcatcaagaattagatttaaatgcttattatccttaaatgcaacaagttgttgttccaaacaccattggtactcctcctctgtctcacccttccatgcaaaaactggaacaccgactgcggcgattgcagcagcagcatgatcttgtgtactaaatatattacaagatgtccagacc

SEQ ID NO: 74 - DNA, 660 bp, Artificial Sequence
  Synthetic
tagaatggagaccaaccacagcacatttcaaagacaagtacgcctaatgaccaaaagtcaaccatcttagtatatcctgtttcatctaggagaacctcaggagcaaggtattccgtggtaccacagaatgtatttgtcgtctcatttttggtcaagttagcttttgaaagaccaaaatcacataaagcgatatgtccattagcatcgagcagaatgttttcaggttttagatcgcgataaacgatgtcatgtttgtgaaggtgctggagagccaaaatgagctcagctatgtaaaattttgctcgctcttcacagaaccttccttctctttgtaaatgccaaaaaagttcgcctccagacatataatcagttaccaaatagagatcacttggagtttggaatgaaaatttaagtccaacaatgaactgcgactctgccatagctgttctgactaagatatttctttcgccaacagtatgggcgacctctttcttttgtacaataacctttttctgaaggactttcatggcataaattcttcctgtatcttttttcctgacttgataaacttgaccaaaagttccttttcctatcagtttcaagaattgaaagtcttcaggtccataatgtcttttccttgttggttgaaatttaacctcg

SEQ ID NO: 75 - DNA, 463 bp, Artificial Sequence
  Synthetic
gtcattatatattttaggcgttacaatcttcaataaataactaacatcgataacaggtcgtataccagcagatactagtaaagaaacgaagatttacccccttcctcatacctatgtagttaaggacatcgtcccagatctcacacagttttacaaacagtataagtccatcaagccataccttcaacgtacatctccctcacccaatggtaaagaatatctacaaagtaaggaggacagaaaaaaactcgatgggttatatgagtgcattttgtgcgcatgctgttctacttcatgcccctcttactggtggaactctgaagaatacttgggcccagctgttctgatgcaaagctatagatggttagcagattctcgagatgaaaagacagctgagcgaaagagtgctctggataatagtatgagtctctatcgatgtcataccatattaaattgttctcgg

SEQ ID NO: 76 - DNA, 577 bp, Artificial Sequence
  Synthetic
ctgaacttttgtaaaaaaatcctctccatcgacggagtcttgagcttctgggtgttttgtaagagagtttgtgttaaatagtgtctgtatagaaattttgccatcaaaagacgcagttgcagaaagtgctggattatgaggatgaaatcgagtctgaaaggtccagtttgtagcttcaggaaattctcccaggagttctccaagctgtgggttccataagatagttctattatctttgccacatgataacagcaaattgctgtcttgttgacaccatgagattgataaaattccctgattatggccttgtaatgtacattctggtgcattggaatttcgtaaatcccaaagaagaataactggttttgtatcatcaggtgttgctgttagtagcttcgttgaattttctggatcccaagcaatagctccaacagctttacgattgttattcaaagtcaatgacgcttttttggtttttaagtcccacactgtaacaaatcctccagttccaccagtagccaaaatatgaggaactttcctattccaggcaacacattcaaggtcatcggatcttgct

SEQ ID NO: 77 - DNA, 1109 bp, Artificial Sequence
  Synthetic
tgataaacctgccttagatactaaatcaggagttggcgttttatgggattctattagagttgtaaatttcaaagatactttgattggattttcttagattaacctcgacgagaatcgattttctagatttttggctaaatcatacgaattcaaattttcttagtaaattggacaatgcgcgccgtaaacatatcgggatgaaattttttaataataaaatcaattgaaaataataaatttatatcctatttaatcaccgccaacaagaagttcgttttccttacctacctagaattagtttttagatatcgttcgatgtttcgtgaatttcaaatccagatgttgccgccgatttgttcttgatgcacctctagcgtatctccatctgccatatcgagaaactcaggactatcagtttgttgaacacgactcccttcaaataagaatcgaacagaagaaagtgatttcccttgcctctcacagaacgcgtccatcaatttcttaagtggtgttgttcgtttaattttgaagaagacttcattattgttatctgtaaccttgatatttaaatgttcacttggagctggtgcctccgatttttctggtgcgcttgagccgtcgtgctctgaattggccattctaagggaggatctaagttggctttttttttatttaaggcttttcgtagagaagacggatggctaaagagatcttaatttatcgtcccgttgctgtgatatagactattctgattgatttacttctcgtcagatatatgccttttataatttattgcttcggaaatcttgagaggtaatagacgcgattgaggggaggttcttttacatagtgaatatgtcaagaaaaagaatagatcaagaatttattccttctttgctttttaatatttttggggtttgttttaactcctttttctttagatattaattatggcttttctagtaatttttctgcatcgacgaaaaatgattggagatgagaaagggaagtagaaagatgcgaagtgctgtaagttcgtattctgggtagagtggaaatgcgaaagcaggcaatgaatttattaaatatggagagagggggggggtggc

SEQ ID NO: 78 - skipped

SEQ ID NO: 79 - DNA, 479 bp, Artificial Sequence
  Synthetic
atgcgtttgacgtaggagatgaccgtgacgcattaattttgttatagtaccacttgtcaaggaaagatttgggatggttagaattgacagtggatagctgactgtattctggcatatgcactaaattaggccacttttcctttgttggaactccgagtatctcaacaattctctgcatctgattttgctggaacggaaccacttttttggcttcgatcttagcttcttcacccttaaatattggtcgcaatgagagaagttcagcaaatatacagccaatagcccacatgtccacggcaggggtgtaatgtctagagcccaaaagaagttcaggggcccgataccaaatagtcacaacaaccttatcaccagtgaataatggatgaagaggtttatgaaatatacgagcaaggcctagatcgccaatcttaacttcaccagatgaggtaaccatgatatttgctggttttagatctcgg

SEQ ID NO: 80 - DNA, 906 bp, Artificial Sequence
  Synthetic
ctataatacttcatctggaagccatcgagtttgctttttattatctgaatttttgaggcattaaactacaatacctattaaggttcaattcaacgttacagtatgtagcagtaaatatcatttttggtataagaataaaaatattcaaatttttaccgaaaaaaatgaagcagtaagtcatatttctgggtcaagtctctgtaagtcttgcgcatcaagcttgcaattgagactccaaatgtgactggatatgtatatatatatatatatggtgttatagttgtcaaatcgaatctattctattctttgaatcagatgtagaccagatgctgtttctatgatttgactcatttctccaactttgagttcgaatgcagcatcttcgaattctttctgcatatcacctctaccaaagaaaccaaggtcaccttgttttttagcactattgcaatcagactcggtcatcgctagctcgcccagtgtctttacgccacatcggatacgttcctcatgtgcgagcataatattgagagcatcctctttcgagcgggttatttcagcctcacgccaactacttgggcgtcggctatctctatgcttcaccaataagtgaatggcccttatctttccaccgttagtcaggttagagctgagccctgcggtccctggcctattactatcagggatggcattaacaccatgatgcagggcgatgtaagcttttaatttgttatgatctgttcctggaggcggttcccatcgggattgtttcaagctttcactgaaataataaggaagatttttcgagttagagtggcggacttcccatccatagggcaaacccacatccgccatgtttaaacagtagctatgaaccgtagatctgaaggtcacactcgagtatca

SEQ ID NO: 81 - DNA, 735 bp, Artificial Sequence
  Synthetic
tgagaggtttctgggctttcattctctaaatcaatcatagataattccgattcaacaggtaagggagtatgtgtccgcgatattccacctgaagcaggtcttgaggatgtacgggatgagatttgagagtcaggtttcgtaataaatagtgattcaaaagatggaaatatgtgagagccactagtattatctctagatgctgttgagaagtcttcatcttcgtcatggccatattcaagactccagtaattaggatttgactccattatactttgtgaaatctgcgcacgctgagcgagcttacgaagtcgtcgtcgttccatcatccgaaaatatttttcatcatcataactctgctctccaatttgttctctttcaatccttcgtcgctcgtataggcatatttgggctgttcctttctttcgccatggaatttctccaagttcgacatgttctaaaatcatgtagatcttcttcaactcaggatcgtcaataacttcaagcaggcctaccacattggcatgtcggacctttttcagaatagcaatttcgcgcttcgttttattctcgggtgaaaacgtaactcgacccagcctacgcttttttgaaaatcgctgaataatcttaatagccacaaaatctccagtttcaaggtttcttcccaatttaactttgccgtgtacacctcttccaatctcgctgatgatttcatattgattgattagcttacggccg

SEQ ID NO: 82 - DNA, 904 bp, Artificial Sequence
  Synthetic
ccgatgtgaagcagaccgtacaccaagttcttttgtgatcatcttcaggcttttctttgttttaacacaaacagcctactgaattagaataaaaatactctcctacacgaaacaaattacacaacgtctagtgaagcgaattcttttttaaacccccccaactaatttaatattatctcaatttattcctcattctcaacttgcggctcttcttcataatcctcctcaccctcagaaattgaggcatcttggtattgctgatattcatgaaccaaatcattcatgtttgactcagcttctgtgaattccatctcgtccattccttctccagtataccaatgtaagaaagcttttcttctaaacatagctgtgaattgatccccaacgcgcttaaagagttcttgaatggaagtggagtttcctacaaatgtagatgacatcttaagaccacgaggtggaatagagcagagtgcggtttgtacattattagggatccactcgacaaaatatgcagagttcttattttgtacattgcgcatttggtcctctacttctttcattgataccttacctcgaaatattgctgaacatgttaaatagcgcccgtttcggaaatcagacgctgccatcatatttttggggtcgtacatttgctgagtcaactcgggaacagtaactgcgcggaaagagtgggcaccgcgacttgttagaggagcaaatccaaccataaaaaaatgaagacgaggaaatggaaccatgttaactgctaactttcgaagatctgagttgagttgacctgggaaacgaagacatgttgttacacctgacatgactgcagataccaaatgattcaaatcaccatatgatgggtttgaaagctttaaagttctcatacatatttcat

SEQ ID NO: 83 - DNA, 758 bp, Artificial Sequence
  Synthetic
taagaatagaaatgtaacaactttttttccccggtatagttgataccatacggttctttggttgaagaagtcggcgcataacatctaaaactgttgtttttcgtacagttttggcctgctctacgttatggccagtaaaaggcgtgtatgaagtcatgagaaaatgacagcggggagttggaataagagaagccacaatgctaataagatcgttatgcatgtagcctggatatcgaagagttgttgtgctagccgacattactgtagagaccaattggttagtctgttgaaatgaaggttcctgaacatgtaggcgatcagctgcaatacgagataatgcaccgttatccaaaaccacaaccgagtccgcattttgagtcaggcgccgcatggagagtagactgttatatggatgaacaacaacatcgcccgaattagtcgtatctgggaatacagagtaagtctggatgatctttttaggaaaacggtcattcagtcgttccaggaggaaagaaccgaggccggatcctgttcctccagcgatcgaatgtaaaatcatgaagccctcgagtgaatcactaccatcagcctcacgatctatcatctccataatatcttcgtgaaccagttctcctgtttggtatccatcaccccagttattggccgccccaactccgttctttccaacgaagaagttttcgggattataaatgtttttatatggaccagtttgaatgccattaataactcttggctct

SEQ ID NO: 84 - DNA, 579 bp, Artificial Sequence
  Synthetic
gcagatactgcccaaactaccttcataattttccgagctacacaccagaacctcgagtattgacattacggaatcatctcaccatttaaaagttgcggtttaacttaagctgtagccgcaacagtttcagctgtcccagctagtccttctgattgaagtttatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgaggttcgttgcgggcctgaagctttttaaccatgaattttggaataggacgcagagcaattttggcagatactggttcgtaatcggcaaatagttcctttaacttttcctcggataagtcataaggaagattggcaaccataacttttgtcttagatggaactccattggca

SEQ ID NO: 85 - DNA, 769 bp, Artificial Sequence
  Synthetic
acctatcacaacaatttgttttccatgagctgtcatacaatgcccggatcgtgcggagggcgattgtcccatattttgaaatgtgtaccaccttcttgatgtaattctgaacgcagccaaatctcccaagtcagatccatcgtcagcccgtcctccaaagacatacatcacatcgtcaacaattgctgcagcatgaccttctcttggaaccggtatatatcctatgcagtccaaaagagtccaggagttcggtatcggatcataacaccaaacatcgttataccattgaagaccatttgttccgccaaacaagtaaagcttttcattatatgtcacaactgagtgatttgttctagctgatggtatttgtcctactgggggtccaccatcctcactatttttaatgagaatttcccacctgttcgtagggacttgcaaaagattcaaatcaaaagccacaaggtcattcataaaataaccctctacttgccccccgaatacgtagattttagaccctagtatattgagagaatgaccataacgccccgcgggccgtggcccggcaggtatagctctggaccattgtcgggtagaggtattaagtaagtaaagagtttcatctaatacgtcagaatcgtccattttagtatccccaccatatacaataaaagcatttccgactagtaagctggcgtgaccaacccttggactcggcccttcagcagtagttgttagaggataacatgccatgttccccactgcctcaacc

SEQ ID NO: 86 - DNA, 1609 bp, Artificial Sequence
  Synthetic
cggccaagcagttcgtcggctgcttctcctgtactctttgccaaaaagccaagtggtggattacgattttgtgtggattatagaggactaaatgcaatcacggtgcccgatcgctatcccctaccactttttaaggaaaccttgagacagctatcgaaggcacgctggttcacaaaactggatgttaaatcagcatttcatcgagtaagaattcgcgaaggagatgaatggatgacggcattccgctgcaggctaggactctttgagtggttggtcacaccatttggtctcattaacgcaccggcatcattccaaaggtatataaatgaacatcttagagagcatttggacctagatgcgacagcttatgttgatgatatcttagtttacactgacggtagcgaggatggacactggagaacggttcgaagtatacttgacaaattacgaaaagctgggctatatctcgatattgataaatgtgagtttttatgtaaagaagtcaaatatttggggtttattgtgaaagctggtaaaagtgtggccgttgatcaatcgaaggtgaaggccattctggagtgggaagcgccaactacggttagaggggtaagatcatttctcggattcgccaacttctatcggtgctttattaagggattttccgacattacatcacccctagttgccctgacgaaaaaaaaggtggaatggcgatgggggcgtgacgaaaatgatgcgtttgaaaggctcaaagaaatattctcatcacagcctgttttagcacagtgggatccagagaaggaaacaattttggaagctgatagttctggctttgcaattggtggttgtctctcacaggtggatgaacacggccaaataagacctgtggcttatttctcgaagaagttaaatagtgccgaagctaattacccaatccatgacaaagaattacacgcaatagtcacgtgcttaaaagaatggaaaccagagctaatttcggtcgccaggccttttaccatcttgacagaccataaaaacttgcgatacttcatggataaaaggcttcttaacgagcgacaggtacgatacaaggatgttttacagcaatctaggtatgaactgaagtggcgacctggaagtacctgtgatcgacctgacgcactgtcaaggcgtgatcaggataaaccagcagacataagcgatgaacgaaatgcagggcgggttatgcagctattaccttctatagaaacttacccaacgacgattatgtccgaggccgaatcagcggatgtggaaaacgaccctgctgccctggccagaatatgtgatgatgaagagatacaaactctttggaaaaaaggtgtaatcgctgaccatgattggcgccgagcacgagatgcagtacgcgctggagagcgaacttttccgcctgaattaaccaaaaaatttacagctaacatagcagaatgctcagttgcggcggatggggtgttgcggggaagagaaaaccgaatatgggtacctgatttcgaaccactccggacgtcgatcatgcaaaaaatccatgatagttctttaacaggccatccaggaaaagacacaatggtgg

SEQ ID NO: 87 - DNA, 687 bp, Artificial Sequence
  Synthetic
cgccgtgaccgaaaatttggtgaaatgatattctcaaagatctgctatagtaccaagctttttccctcctcccgtcgctctctgagtcgatgcagaagaatttgagctgaccggggcgctattacgattaaatgagctgttttccccagcgctataagcatccagggagaataaggttacaaaatataatccgaaaaaagataaaaaagtatttatcaattgtttcaaatcgaatggcttagacaactgtgtactcggactcttagtactccctagagttcgtccttctgaggtatatgatagaccttctaggcctgcaagtctgatgacagactcgatagcagttcttaaagtagactgatcagcgccacggatcgtattggcaatagagccagatcgaaagataatgaagctgggaagtgctctaactccataacgctgagaaatatcctggtgattgtctacattgaccttgacaaaggtgatcctgttcggtttcgagtatttggaagcaagactttcgaaggtgggagcaatagcattacatgggccgcaccagtcggcataaactaacccagccattagtagatttagttaatcggtgacgactacttttgaagagttcaaaattttgtcaaactgagatgaggatctgatacggatagacatgctttctttctgttcaac

SEQ ID NO: 88 - DNA, 656 bp, Artificial Sequence
  Synthetic
tacgattccactgacaggtgcttctcctgtggaatcaataacatgaaagttatcgccgaagtcgcagaatatatatccaaataatccaaaggtttcagttattactacatatattcccttctcatgtagatactgggagattatgagctggtctttcagtggaatatctgtcaatattacagcttgatatgaatcaaactgggagagatcagaaactaagcttgtggagctgtgaatcttaacaggggtgtaagcatttagttccgaaactcgttgagctgagacaatatctctaggttttcctatatcttctgggttaagaaagaattgagatgataggtcagcgatagttgcgggagcgggatcgtataatgttagacttttaactccagccagagctatattcttagctatttcgataccaagacctttcaagccaataataagaatattcgatgcactcattcgtttcatagcctcgtgtccaagaacgtagagttgcctactgtataaagactcatcgataacattattattttcttgtgactcatcaacttccatcttcatcttgtcttcaattttactgacttcactcatcttgaatacttcctgtaaatccaatttacatcaactgaattactagcttccacctagtt

SEQ ID NO: 89 - DNA, 787 bp, Artificial Sequence
  Synthetic
tttgactctagttttaaatacacataaatgtttgctcaaactatctagagattttgcgtcttgtaaaaaaatactatatatgaaatattattgtgtactattgatgtatgaactcgatgtgaggtttaaaatcttattgctgccatagataatcaaaaaattatattaatcctatccttttggaacgattcctaatagcagatgtgtgttcgtctctgtcctttgaatgactcatttcagtccaaatcttcgttgctaattcatccactcatttcatagcatatttttttgtcgctttaaccgcctcttcattaaattcattcctgttattcctgtatctatctgctaatgccgtttctaccgcatcatcaagtaccggctcggtcagcatttgctgcgttgccatcaaaatattgatgattcgagatgatggtttccaggcatctggtttgagagcaccaatacacatactaccctgctcatcaaaagtcacatttggatggtagatacgagttttgaacgatagttttggtggcttaaaaggatagtctgaggggagcgttaaaagaagttcaaagttaccaccagcgtatggcgaatcctgtggcccagataaaataattttccagttgagcagacttgactcatcgacaaggcttacttgcattccagctggtgagttttgagaaatctccgcgagctccttggctattcttttttgtgcattaccggccatgctgatgggtctttcgcaactccaaaggcgaaagtgagaattcgtaacttg

SEQ ID NO: 90 - DNA, 949 bp, Artificial Sequence
  Synthetic
tttttttccaaaaaaaaaactcatcaggtttttagaacacaatcaaacgtttggcccttaatagtaccgccagccatactatttctaacatttctcttgaatatctcacgatgattccgaagatcttcggcggcttctttattcaacggatccgaagaatttggctctaaaaagagaaaaataattaaagaattccagtagcgaactagaccagagtagagcaggaaggagtattcgatgatacctaaaaaaagacacacacgttataaaatggctctaagaatggtattgaggctaatgtatatttttttctttgaaaaaacaaaaaacaaacaaacaaaaaaattatggataataagtaatcctaccactacactctgtagatttaggaccggtttccagtcctcacgcaagatattgagacacacgtttccatcaagatcgatatttggatgataaatcttttctatacattttacttttggcgcttcatgagggaagttttgagagatagaaaaagtgaattgaaaacggccacctttatacatgccctcgtctggcatgattgtaagtttaaaattcaatgtatcatcagggtctggaaactcggtgaacatattggatgggagcgagagctcagaaagatctttctgtgcacgtaactgggcagctgtcactttttttttcttcgatctagtggccgtattttcattttcatctttttgctgttgctgcttcagagaccatattttcaacatttcgccgttgtcatgcagagatgctaatgtcactttggaccgaagattgacttttttttttttttttttcctgaggtctgctaaggaaagagttgaacaggttagggtgtgagtgcaaggtggggcatgctattaggtccatggcttatagttaatttatctggcgaataccgcttatagaccagagtaga

SEQ ID NO: 91 - DNA, 604 bp, Artificial Sequence
  Synthetic
ttaaaatttgtccatttttctagtactcttgagttcagtgaggtcgtcatcctcgtcttgttcaaaatcatagttatcatcgtctgagctctcgctggtaccgaactcatcctgatcatcactctcgttccagaaatcatcgtcatcattaatttgcggaggaggcgcctcaattaatgtttttggcatcacaaaaccctccggtatatctctcatagaaattcttactgtctccaaagcccgctgtttgtaagcctccaggttatcccgatacataacgctggcatcaacatttgcaggggaggtaatctcagggtcatctagtaagagaagaatagagcggagaacactttcaacactctgaattgatgaccagcgctcacaagcaagctctccagattgttcatcatctccagcagcgtgtagtattgagatgcaaaccctgccatcaggatatatatttggatggtaaataggttgcaagaatttgaaggtcggaggagcataaggatatttatcagtaaaacccatttcagccttaaaataagccccatcgaaagcactttctgggttgactactattagagcgattaaccacttgaag

SEQ ID NO: 92 - DNA, 1046 bp, Artificial Sequence
  Synthetic
agaaaatctaggcaaatccttgaaaaactcagagctttttttttcaataaaattcaagtcaaaaaaattcagatcttttcgattttcaggaataatcaatttatttctgcgatttatcgcttgatttaaaaatatactaggcacccaaaaatcttgacttctcacattttctgtcccaaggacaatagtttgctgaattaattgtagatctgtatatatctgttgactcattttctgaagccagaattcatctttcggtataacaacgccattaatgataactgggggaacaaggtcatctgcacaaatcctgtctacccatttttgggacgattgaattcgactctcgagctcatctgatttcaaaacttcgtcgaaaattattcgggttttattagtcttaatttttgctttctgggtgatttggtcgaatacatccttactgtttaagctaagctttgattcattttgtgaccgtaaatatgctattgcagtttgtaatccataaatttcaataaggtgataaattacttttgcttcgattgcagcatttgagtttctgatgacgggaatgagaccaattcggatgggcaatcgccggtttacgaagtttagagccgtctccaagatgagctctaagtctagttgatcagtgagatcaattggtatcactagattaaaagcatctcgacgcacaaacgggagctgccctggatatcctctttgtaacatagcagctagtgagactggccagtctgcataacgcctatctttctctatgttattaagccagataataacatttcctccttcggtcttatctgtccaatcgaacctatccactccgtctaatgtctgcgctgagactatttctttgtgtaacaacaacttgattgcttctgaaggcgtaaatccaatgtcagacataccgctaatgattttgcgctctttacgcattatgtcaattaaatccataatctgcatttgtctttcggtcaatggcaatccatttatccaaatattattacggccaccttcgattgact

SEQ ID NO: 93 - DNA, 1106 bp, Artificial Sequence
  Synthetic
cctctttccacataatacaactaatgacatttttcccatcctttaccttgccatctcttccaacctttctcttaccatcaaactttgttccttttactgtgatcctctcgacaagttttccgctcaatgtatcccagacaaccacttcaccatcttgtccttcaatattctcgtttccagaaagtatccatctctctcttccaccaaaacagttccatattcgaaattctttgttttcccagcaatctgcacgataactccttagtaatttaccattctcggtatccattagtctaagctgactatccagtccacctacaagtagaccttttttatctattgtcttccttagacatgtcacaggagcaccaataacatcgacaacaatttgtcccattctaatgtcgtatttcctaacttttccatcgacactactggtccatatctcgctatcactcgctaatacgcagctcacactatcaccagcctctgttagaaccataactggcttagcactcgagctcttcacatcccagatacgagcactggcatcaaaacctccactaataagaagactggctccatccccagcaaaagtaacggtattgatgcgtgccgaatgaccattgttgccactaaatcgtcgtgtagtgacagcagtggctacatcccaaagaaaaactgcacgatcgccaccggcagaagcgaagctgccattatcgggcgcgatagataatgaaagcacttcatagccatgtgccgaataactctgtattaattgtcccggtttaggccccgtccctgttggtaaaattgaattatcaacacgtgatggattatacaaacgaattgtccgatcggaggagcctgtcaaaatgtatgttgatggagacgaagagtaagtgacagcatggactggtcctacatttaaatgccaagtcaggtggccggctacattatagcatttgtgtagtattcttttcattggatccgagaagctgtgcaagaggttttgatggaaaggccataatactctctattattacattttactttttttttttcttactctgatcttttcctggaacttataatttccatccgca

SEQ ID NO: 94 - DNA, 630 bp, Artificial Sequence
  Synthetic
ggctagcctgatataaaaaaatggtagaaatgaatagtttcagtacgtgtgcttgccaatagatcgtttttggttggtcaatagaaaatcaccttgatggactgaattttgagattcggtaaagattcgccgtagcaggacagcattgattggcaggaacccaatttttggacgctcagggactggaatcccgatggttaccgggcttctctcgcattgcctcttcgtgaagcaagctgagaagttgggagaaaaaaaaaagggagattctagctcttcgggactgtaattttcattcgttgacgtttccttggtctacgttcccaatcaactgactcatattgaaaaatagtttgaggcacagaaagaattactagacacaatggctccaattgcgacagctgacttgcgttcttcaagtgatccaaatgtcaaagaatcaagtgacgagcagtcaaaatcaaacatcagacaattacccgtgacacttttatctggatttctgggaagtggaaagacaactcttctcgagcatatcttgcgctctaatgaacatggccttcgaattgccgtgattgtgaatgacatgtcaagtcttaacattgatgcttctctgatccaacaacacac

SEQ ID NO: 95 - DNA, 608 bp, Artificial Sequence
  Synthetic
taataactatgcttctcttagggacggttggcatcattattaattttgcagaaccaattccatctcgatcttttccgatttattctcaaaatggagatattgtttatcctcaatttgcatatcctcttcgcaagaatatcattccaatttgggtagcaattttgttggcttcacttattcctttgctcatcattttccttacacaatttcgtattcgctcgttttgggatgcaaacaacgcgattacagggctattatactcccttattatcgccggagtgtttcaagtcttcttaaagtggttaattggagggctgagacctcattttctaaccgtctgtgagccaataattccaacacgtgctccaataaaggctagatatgggcctagaataataatgtacgacagaaatgtctgcactggcgacaaaaggcagatcaataattctcttgaatcattcccttcaagccaatcgactgtagcattttctggtttcgtttatttggctatatacctgaatgcaaaacttaaaatttggtctaattaccattctgccatgtggaagatggcattgctatggtcccccatcctcattgcaagtctcatt

SEQ ID NO: 96 - DNA, 949 bp, Artificial Sequence
  Synthetic
ttcacgttcgtgattgagcttctccgcattgatggaggtttcagctatagaattgcattctaattctagatctgcaagttgctttgaaattttcacttgttccccaagtaaatgtttacgccaaacgtctgcatccaaaacagcttgaagcgcaggagtatcatctcctcttatctcctgttcaacgtgaagtattgaaatatgagtaggaatagctagttctcttcgggcaagtgcacgtaacaaagtagattttccaataccattctgaccgacgagaccataccttcgaccgtacgctaagcttaaattggtatctgtaagtattcttaagccgccaatagatacatcaattccatcaagttttatatctttgcacttttgctggccttttaacgatccaagttgaaggggattgacggccatgaaaaattcttcgtatgactgcgtattatctgcttgattaagaagccgtgaagcttcgtactgaactgttttaaaaacctttttgctctgtttagcggcaatttttcgttccgctttttctagttttttgcgatcaactttcgattcgagcttccgagtacctgcggattccagatctacatcaccaacagcaaatccaatagttgacgacattagtgtttgtgatcctacttggattgcctgatctagacgtttcactgtggaggagtttttttttcggcgctcatcagacgctcgagcatccaacgtctctagccatttttgaataagttgttttatgattgcttcattttcaactgagaagtcaccagatgcagataccaggagttcaaagacagatcttgcggagtcctctatcattaacgattctgctggatccgagtcttgtgagaccatattcgaggcatgagtaagatatccgacagcatattcagatattaccggatcaatattgggtattatg

SEQ ID NO: 97 - DNA, 913 bp, Artificial Sequence
  Synthetic
ggcgtgtcccatatttgtaaagaacccttactgccagcaacagcgagtctgaatcggacttcttggtcaggcgcaaaagaagttgaaaatacctttccaacttccaaatctctggacactatcattgaggggcccgatggctgaatattccacagttttacgagtttatcagaagaccctgtggccataaacccgggaatgataggattaatatcaaaagcacaaactgatttgtcatgtgcttgcaataaccaaactggcttactagaactgggagtagatggtgccattcgtatatcgtgataatggaccataccaccttctgtcgttacgtaaaagaaatttgggttgtgtgcatcccatttgacagcttctacatcactttctacaccccaaatcggcactttggattctggtgctctcatgtcggccgctacgacactccgatcataacttccactaagtaagacagtggagtcaacaggatgccattgtattgagcaaactttatctgaatgattactatatgatttagcacatttattagtattaaggtcccatagtttgacagtcttgtcggcggaagaagaggcaagtaaattttggtgttgtcggtttgctgcaagcgagagaacggcgtcgacatgaaatagatcatttggtttcttagactttttttttttttttttttttttttcttttgtggaaatattgggccgcgtcggtgaaaatacgaagtgaaaacaaaacataatgtatgcaatttggtcccgagatattttcgtttctttcttgtcccaaaatggcattagggtacatacaatcgatcatatccaaatcccatatctcgatatcagggtccaacgttccaacggcaacaaagttagttcctgacttattttctgagtctgtc

SEQ ID NO: 98 - DNA, 479 bp, Artificial Sequence
  Synthetic
tccccgaatttttggcatccttaaccgaagacaccaaattatgatcggcttcgcctcgaaacagttgcattatttcatgcatgcccaacttgctaataccattgtttttaccgccttcgatcgtttgttgagctaactcacgctttttttcttgcagcgtgagaatacgttcctcaacactattagcaatggtaattttataaacgattacatcagttttttgagtaagacgatgtacacggtcaattgcttgttcctctatgaatggattccagaaaggttcgaggataacaacgcgggtagcagctgttagatttaatccgagggatccgcattttaaactgcataatagtacacggcaagaattatcatttcgtaagctgttgagactagcttcacgcaaatcatttctcatttttccatcatatcgagtgaatttgaagtcattctttagcaaaaatgactcaatgaggtcaagc

SEQ ID NO: 99 - DNA, 966 bp, Artificial Sequence
  Synthetic
tatggtcattacaaatgccaaaggtgctatgtaggttgaaaggtaacctatgcgcaaagggggtatcgcttgtgaaagtgcaactaataaaaagtacatattgaaaaagaaagaaaattcattgtataaggtttttggtaagaagctaaacggagtatattttgcatttgatacacagttgagtggatatcttatggcttggggtgttccaacagacaccaagcgtgacagcgaaaggtcatatccttcggttgtttctaagccactgttttctatcgctgtgctagatcctgtgattgatataaagcttggcattcgaagattagtccctaattttgcaaacgtatctcttcgcgaccgatatccatttcctgagggtaacagagaatgatcttcagcactgtctgggttgtatctgccagttccctcaacatctgggtcgtccctcaataagctatgtaagtcctcttcagcgtagtctaaattccttggggccccatttcttcttcctaaccctctgaatccgctcatgcgtagatttctcaacggaatattgctttcagttctccagtcatgcgctttcggtttgatcccttgttcaagctcctggatatctaaatccagatcggagtccgaatcagcttgaggtggaatttgatcgccctgatgataatatgagcccgaagacatgcctcattgtattttatcgtttgatctctataatctcctaggtgatgttataaagcttgaccgcataaaatcggttaatcatttaagcaaatgcagttgcggtgtgtcatatctttcacggcagcatctagtatgtctagtatggctgctactgtattttaaataaaccaaaacatgttcaacacatttcataaggtataagaaggattgtgaatataatttactggtaaattttaaatcatagttgaaaaccttcgcaagcctcgtgcattaact

SEQ ID NO: 100 - DNA, 607 bp, Artificial Sequence
  Synthetic
taggatcttcttttgctctgcatttcaactcgaataacctcaattggttgattccacgcactcaaccctcccccaagggcactagcgagaattcgttcccaagcacttaatggaccgccattttcttttcctgaaacctttcggattccctgttctgccaaacgacttaatccaaatctggatccccaattcgtcatttgtcgaatggcaacagcattcacacctttattaatacctctgatcccatctttacggtatatatccataaatgttgagaaagttcctgggggctttacaccagtggatgctaatttggatttcgtaatctccacagttttcatgcatgtacaaaagcccatagtggcatatgcttgagccatacccccgacaacgcctcctgtgatgccggctgtgaagatgccggctccaaaacttcgagcatagaattctgcttctgaagcgacaaatagaagaactgcaccttttgatgaagcttcaatccaagcccatgggatcaagccctgataaaaacccaaaacaccgcctcttgcccatactcttcgcagcgcagcaacaaagttgtcgcttctatttgccgccatggtgg

SEQ ID NO: 101 - DNA, 1383 bp, Artificial Sequence
  Synthetic
ttttttttttactacaaattttttcaattttaacagaggcgtctagggacattctcattcctcattcatcatatgcttatagagctaacgtacatacaaaaacttgattcgaaaatctcggtgtcctcacattaaattttggttcataatctcgccttttggcaaatgaaattacttggaggtaaaaaataacaataataattaataacgttaaagcgtgtaatctttgacttcctcttcagtccattcccaaagctttttggcaagcccatcatcataagtaagctttccagcctgtcctggtgcgcctattggggtgtagaattcaccaactacaaccttgccgttagatctggagcaacatgactgtacatctttttctgtagctctgggagcagtcgcagcccatagctgcgtatttgcgccttcttttgcattcatcagaaatatcatcatcttccttgctatttttagaaatacggagaatataggccatttttcaatgtattcgtacaaaccggtatctacgacgcctggatgaatggatacagccagaatttttgagtcttgatttttgagttgttttgcgagttgtttagtgaaaagtatgttagctaatttactttgtccatagcgtcgcatcgaaagccagctttccatttctgttttgagttcagaaaacacaattccttggcagggcgcaaagtaatgtgcaatggaagatacactaattattctcacatctgttcccggaagactagttgttttctctaacgtcggaagtagtagttttgtgagtagaaaatgccctatatggtttgtaccgaactgaatctcatatccttgctttgattttcccgcgggtgtcaccataattcctgcattcaaaaacaagagatctaatctcttttctctgttaagaaattcccgtgcacacgatttcacagattcgaggtctgctaagtcgcagggtaggtatgagactttagctgatggaactgcacttttgatacttgccagggccttatcagcagtagtctgattacgacctgagatgtagatatgcgcaggattttttctagctagagcaagagccgtctggtatccaatacctctagtccctcctgtaatgaaaattactttctctgactgatctgggatatccttctcttgcgagaaagagaccccaccgaataacagtccgtagagcattctcgttctcttactgtaaatcaattaaatctatttcctgtgatgcgtgattcagtgcgaaaggtgagaaaaaatcaagagcagctagcggcttaaatactcctcttgcaagcagatcatgcatgccaataagaatattcaaggattcatgtgattcatcacgaatgaaca

SEQ ID NO: 102 - DNA, 1297 bp, Artificial Sequence
  Synthetic
cggggggtggtgaagtgaacaaatttttattttcaataaaatctttaattctaatggtagctgacattatgataaattttaatggatagatggaggggttttcgactgacatttcttcgcgtaacttaacaacacggctaagcatgccaattaaaatgtcagtgttcacacttctttcatgagcctcatcaatgatgatagctgaatattttcggagtgtaatatcctgtgctatctcccgaagaagtactccatctgtcataaacttgatagcagtctcaggactaacagttgcttcgaatcgaatctgataggcaaccttcttttgaaggtcgcctagctcatcccctagacgcttggccatactaacagctgcaactcgtcgcggttgagtgataccaattattccaggtgttgacgattctgatgaggcataaccagcctcaaagagaaattgaggaacttgtgttgtctttcctgatcctgtagctccacaaataacaactgtgttgttattaaatactgactccattattttctgctcttcggctactataggtagctctaatctcattttttcaatttctggtggtcttgttaccgcaacactgtgtgattttctagttgagttttcagttggtcttaattcagagggcaatgggtcttcttctggtgcccttaacttgatggtaagattattcggcagagtttttaccatttgaatatttggtattgatttatatccttgagcctcatttatttgctggatagcccaagccttaaacgcagatctttcttttctaggcgtattctcaatttcatcgcaatcatcagaactttcattctcatcacggctactttctttactgctatctgactcgtaatcagataaatttggtccaattttatctccaacgtcttctgaggaatttgtcatgtttcctatggtatcacgctggattgacatacttgaatctgagtttataccttcccattctgattcatcatcggtgacaggcttgcgaatatcaagagaaaatttagatacaatgccgcctcgtcgttttcttttccccagaataggaattccctccttacttatttcgagtggctttttttaatccagctcccacagttatatctgtttgcttctgagtagtaagtactgaagctttagaggtctcatcgatattatcgtcacatggagatattctcagatcatcattggttacagtactctcatcggaattgaattgattttcgttcgaatcgatgctgacacctgcatcattatttc

SEQ ID NO: 103 - DNA, 620 bp, Artificial Sequence
  Synthetic
cgcgttcataaaatatatcttcataatcagcgtatttaggtgaaagtgtagtagccaatgtccacatggcatagcatagacaaattggaggacgggtctgaattggacgttccaaagacatgtaaaaccgggcttgatgtatgatgggcattgaagggtgatagagagtgaagtagatatgatataattctttaatcatataatcaggcggtaatggttcttgaagacctaagcttagtagctctttattgatatttgatgtagtttctttaggcatctgggagaagcctgaaataggtggcgacgtttcaatggatgtaagaagaggcctaccatcaattgccaaattcaaatctatacccatattccaatttctttcgagccggggagctgcagcatcgggacttatgatatcgcattttccttccgagttgagtcgagtctccaattgagctagcctagcttcaatttctttttctttgctggatcgtgcccgcttggctcctagatttcttcgtcgttctggatattcgcattcatgccttagtcgcacacacgttccacattttggctttacgcgatcacattttaacttgcgcttgcgacaggatacacatgag

SEQ ID NO: 104 - DNA, 1063 bp, Artificial Sequence
  Synthetic
cgggctgtctgtgatgagatacccatccctggcttaagtattgatttatacattctaaaagagagttcgacgcatattatgatctacatacggaagtttggtaggatgacgaaaactcctaacttttaaattgaaaattcaccaatctgacaacatatctatcttattattgttgccctaatcactgcctttaatgaaggaataaaaaattaaaagatgcccgtcactgactaacgctttttttttaattagccaaattatcagttaactgcaaaccagctacagcgagacggtttaagctcccatatttacaaaaactgacttgatttgagtgtaaccagctagaccagcttctcctagctcccgtccaattccactctgttttacaccaccaaatgggaccttaaaacttgaatcattacttgaattaatccataccatgcctgattcaatttttcgcgctacccgatgagccctcgtaatatccttggtaaatactgcactaccaaggccataggtagtatcatttgctatctttagggcttcttcttctgttttaaagctatttatgacaacaaaagggccgaagacttcttcacgaaatattttcatagatggcttaacatccgtgaagattgtaggtgttataaagaagcccttcccgtctttctttgcttgagaaaagggttctccacctgaaaccaaagttgcaccctcctcttttccacattttatgtagctaagcacgcgttcatattgggctttagtcacttgaggtccttggaaggtactttcagaaaatggatcacctacaacagatacttcctgaacccgttttttaaataaagtcaagaaagagtcataaatactttcttggactaatatacgcgaggttgcggtacaaacctggccttggttatacatgatacctatgtgagcccacttaactgcctgctctagattggcatcatcaaaaatcagaagaggtgactttcctccggtctccaaggtaatatttttcattgtacccgaagccattttcataatctcttttccagtaact

SEQ ID NO: 105 - DNA, 723 bp, Artificial Sequence
  Synthetic
ttttagaagatagtttgcagcaatccatccatataatccctcagtctctccagatataacctgtacatgtaattgacaatttgacaagtagaaatctgaatgtgttttagtataggagcatatttcattgattaatgctttttgttttgtcgcttctagcagcctaacacccgcagttgccatcagaaagaagggagtatctttaacttgattctcaggtacaatactcaatgcatgatctagtaagctttgaagatgttcaggaccaatatctgttatgcgatcggcaaaggaagagacgccgggtttgattttttttgaatatccaggtttagtgtgtaactgaggtagttggttcaattgaatctcattttttgcatcgtaacgagctcgagatgtattgagccaccggtagacgtggactcgagtccctgacgagcccgcgtctaagataaccccccatcgccatttacccataagtagcctatcgttacggtttggcgatgccggtctaggatatgtgcttcaatatcaaaaataatccgtgaagcgttacaaaaacatgagtcaattatacggaatttgaaacgagtgtgaaaggaagtcggcagactcaaaaataaaaaagaaagataataattcgaatttgaatgagaatgagtagtggtcggataagatgtttaatgctaagtgctaagataactgactaagacttgatcgccg

SEQ ID NO: 106 - DNA, 481 bp, Artificial Sequence
  Synthetic
gggaatattacggatcgatagacgggtgagtgaaagatgaagtgcaggatttttctctataagtttcttacgttgtagcgccgaagcttctctaagtttaatctctgatggagataaaacgttatatataggcgtaccaacagcaattgtcccctctttaagtagatataactttcgcttatctttgtctcggtcagtgcggaagtttgtcccagcttctgtaagttttacagctttttctcgattaactgctcttgacacttgaagtacgcgaccttctattgtgtataagccattcttatcagcagtttcatcctctaaaatagagtttttagctttaacagcgtttgcaccacttttgaaggtacgaggtgcaccatggtaacaagagtccgcatcttcttgtctatagaagcaaacaaagccagtgcctttaggtcgaccagtattattgtctatgaccactcgagcgtatcgaatt

SEQ ID NO: 107 - DNA, 923 bp, Artificial Sequence
  Synthetic
cccacaccataattatctaaagtaaaatcattgtatgactgcgatcgatgaatttgtggtggttgatgtgacaaagtgtgtgggatcaaggtatgtgtgagtggtataccatgagaccattgtaaatgacctgagtgttgaggagtggatggagaatcaccattttcagattcggaagagtcaccatcatctgtttctgaggaatgaattccatgctgatgtgagcgacgctggtgtttgaccattgtggtctttcgacaaaatgatttcaaacagccctcgtgtgcacatttgtatggtctttttcctgtatgaatacgacgatgacgagccagactagatgaatcagagaatcgtttcccacaaccaagatgctggcattgatgtggcttttcgccagtgtgtgttcgaatgtgcacagttaaggcacttctttgaatgaaactttttccacatccaggctgcatgcatgaatatggccgttcgttggtatgtattcgatagtggcgttgaaggtcagacttcctgttgaaactcttgtgacatgtctgccaatcacactgaaatggtctcgcattaggttcgttttcaacgagctccattacatccatagtgaaccgacaagtagtgtcgaatgtatgcaatgtcggagaagttaagggttggacaagaggtaccgcagcaaaagctgcaggtgtggtgattaggtggggatgggtgtcgaatatataagattgcgattctctatttaaagaaaaaagaaatataagcaaaataaaatatttcttttgatggtaattacaccgcggtttgcttctccgaattttctttttcctttgctcgttaaattgacggcattcgatgtcaagccgctgacccgaatcgcaacaagggatgttattcaaaattatgtttaagtattt

SEQ ID NO: 108 - DNA, 497 bp, Artificial Sequence
  Synthetic
tcttaccatgaagcgttccattcctatgtaacaataatacaaaatgaagtagaggcatatataaacaattgcgttagctttcagggtgagagtggcacagtaaacatctcaaaagttatggcggaaatcactatatatactgcttcacatgccttacaaggagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctaggacttatatgaatataatccaagctcgtagagaagagaaaagaagcggtgagaataagcatgatataatgtgggagttgatgcgttccacttataaagacgggactccggtacctgatcgagagatagcgcatatgatgatagcccttctgatggctggacaacactcttcgtcatccacgagctcatg

SEQ ID NO: 109 - DNA, 449 bp, Artificial Sequence
  Synthetic
ctcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacagttgaaaaagacaatatttcgaagttcccgagagctttcgtatccggcaatgactgcatcacgtcgaatttctacgatccaagacgaaaatagtttgtttttttgctgttggcgtggagtctagctgttgtgtacccgaaccctattcggatcatcaaataggattgtaagttggttcatcattttatgaacagattcaaattgtattaccccattcttaatcaataccatgcaggtgtgactgacagtc

SEQ ID NO: 110 - DNA, 460 bp, Artificial Sequence
  Synthetic
ttggaagaaccgccagaaaacccaatcagataccgatctctactcggatcatcatttcacttcgcaacatgcaattaacggttatgtaccttctataggctttgaatccgatggttatgggattagtaagagatctaatcgtaaaactgttcatggatattactgtgggagctcaaaacatgagcagcatttttatgagcaggactatattaaaatatatacatgtcaaacataatgcaaacttaattccatatagttaactgaaatggtcattttttcacagctttaactcaattccttttgaagagtgataacttttacttgcaattcctaattaaaataagagcacaagccttaatttttggatctaaaatatcaatgccaaccccttgtgcactgttggtagtgaaaatcttcgttatttgtgacaacatccacaatctcgcactgcgtattgata

SEQ ID NO: 111 - DNA, 481 bp, Artificial Sequence
  Synthetic
agtagcagcggacatcgccgacggccctacactgtcagggctacctggggttgcagatttcgacttgtcttcagcgtcctccccaagtctcgagaaaagactttgttttagacgaggatgcaataaaaaatctaaacacgcatcaggcttccaatgtaagaagaaacatttcagtctggcggcggtagaaaaagcaaaagccgtagcctgcgcaaagatcaaagaaaacaagcagcgcaatgcctttcctgctctttacaccgcaaccgatttcgaaactcccgggccttatctagaatggccaatcaagcgcaatggaagattttggaataatttgagaagaggccgttaccgcatcatcctaaccgaaaactgcaaagttgtcggtgctgtgatccggaaaagcaatggttcataccgcacatgcaagaaactgagcgaaaaagatgaagatgaagttgatgatgatgatgaaaaagaa

SEQ ID NO: 112 - DNA, 475 bp, Artificial Sequence
  Synthetic
atgcgtttcatcataggagctgtcgtctcttcactcattttgtcgccaatttcagtgctttctatggcggctagtaatgactctaccgaagctgcagcgcatatcataaatgattctatactagaagatgtttcgaacgttgcagatttcgactggtcttcaacgtcatatcaaggcctagagaaaagattttgtttcagacgaggatgcaaggaagaaaagctcaagaggacatcaggtttccaatgcaaaaagaagtacatcagctcggagaaaattgagagagcaaaagccgctggctgtccggaaatcaaaaaaaataagcagcgatccgcttttccttctctctacactgcatccgactttgctgttccaggtccttacctagaatggccgatcagccgcaatggaaggttttggaacaaattgagtaagggcaagtaccgtatcatcatgaccaaaagctgcaaggtgg

SEQ ID NO: 113 - DNA, 490 bp, Artificial Sequence
  Synthetic
atgttcaaaaaatttattttcctctcaagccaggccttaatggtactttcgaatcctctttatattggtgataatcatcttccgagcgaccaaaataatccgttcttaatatcctatgattggaaagctggctttacaagcgaattcgaacttcatgattcctgcaatgcaacacagaaaaaacagctgcaagacggcctctctgacgctgtgacacttgctaggcatgctaaagaacatattcttgtgaagggaactgaatcacccatatataagaaatatttcggtcaaggtcctacaggatcggtcctgggatggtatgacaaaattgcttcttctgaccgaaaagacatccttttccgttgtgatgaccccgataagaattgccaaactcaacctcaatgggctggacatcaccgcggaaaaaatgcgtcattagagacagtgatctgcgagctttcatttctcactcggcttccacttgaagctc

SEQ ID NO: 114 - DNA, 226 bp, Artificial Sequence
  Synthetic
acgattatcgccaattggggtgatactgttgtagtacatgttactaattcattaatgaataatggaacgagcattcattttcatggactccggcaattcgaaacaaaccaaatggatggtccaacatcaataacacagtgtcccatagctcccggtgatagttttacatatagatgggttgcctctcagtacggaagttcatggtaccatgctcatttcgccgtac

SEQ ID NO: 115 - DNA, 590 bp, Artificial Sequence
  Synthetic
ctgaattgttttgagactgtttattacgaaacccattacttttgtctttgatatggaatctccgattgacaaacaatgtttcgtcaggttttggttcatagctagtggtcattccaatggcacctctaatgttattaataacagtattgagtgattgctcaggcattaaacaagctgggcgacattcgggtatatttgaaacagattgtaaaattttgtcacgaagggttgtttcgtcttgaaaatttggtcgcaagcataactggagattacgaagttgttttactaatatttcaaatacatcaagcaatggcttttcagaatgttgactagaaagaagttgcaaggtaattttgttccattcattctgtgcatttctctgtttttgtggtccttcaaattggccaagcattaattgagagatttcatcgatctgtattgcattgctacagcgatgatggtagaagtctaatgcttctttgttaaacattaagaacatagaagacaggatgtctttttcattttcgatgctcgctaattcgcattttttcaaaaagatgtttaacttgaagttatagctatcatctttt

SEQ ID NO: 116 - DNA, 577 bp, Artificial Sequence
  Synthetic
ttccggcgtgactttgagacattagttaatgctacaagagatcattttgaggggcctgaaatcagacgtagaagaactgctagatgggagtcacccactttacaaaagataatcgatgaaaaccaaggaaaagaaaagtccatggacgattgttttacactattattgaatgaactaagataccttcaacttagtctagataaagagttccgaacagaaaaagtccttcatacaaaactaatcaactcctgccgcaatatatctgcatgtcaactagcatgtttcaaacctagcaatacattgacaggcctcattagcgaccttcaatcgtcaattgctattagcgatgagaatatcaaagatcaatcatcacaattctttacagatagaaaataccacattaactctcaaagtatcaatcaaaacaaacacaagtctaattaccagtctacatcaaaacgaagatgttatgtgtgcgaaaaaccaaattgccattcaaaataccactcaaaatcagagcaagacgaggctcgaaagaaattcaaaagacgttttgtcaaacgtttcgataacatga

SEQ ID NO: 117 - DNA, 597 bp, Artificial Sequence
  Synthetic
caatacttatagacataatgtatattgataataatctagtgttgcatatcattgatgaagcaactaattttcaggcggctaggtggctcaataatatctctgccaaacatacatgggatgccatacgtgcttgttggattgatacttacgttgggcccccagactgcataataacagatgctggtaaaaacttcgttagcaaggaatttaatcaaaatgcatcatcaatggaaatttcggtgaaaaacgttcctgttgaagcgcattggtcaataggaaaaatagagcgctatcactcttgcattcgtcgagcttataaaattatatcagaagaactagctggaaccggaatcggcaaagagtttatgctccagatggcggtaaaagccataaacgacacagccggacctaatggcttagtcccaactcttttagtttttggagcttatccaagaatgtcaaatttagaccctcctatgccatccataattcaacgggctgctgcaatcaaaaaggcgatgctagagataagtaaattacgcgcaaagctaaccgtgaatagtgctctaaaccatcgaaacggaccgaatacgaata

SEQ ID NO: 118 - DNA, 565 bp, Artificial Sequence
  Synthetic
acaatcccctttgatccagcatatatgagtaatttcacgtctctcatatgattggcggaggcacatcaaatctatcattaatcttttttctctggtggttccgagcttcaccaagcattcatatagtgatttagagtctgtacaaacaatgagaggtattcgcatactaaatattttctcaagtgtcgattttatggttgctccagagtcaaaaccgtgcaccattgcataaagttcagcagcgaggacgcttctagttattcttttgcatttaattgaggaccaatggagaatatttgctcgattctcctcgtctgctagtacaattacaaaaccaatttgagatgagaagtctttgttatttgcgaaggatgaatctgcaaaaactattactcttaatgagtttttattgagtttaacgaatttcaatcctctagaagcgttctcaatttgccagttaattcttttattaagtaatttgatatctgcttcgtttggattgacattttgggcagcagaggaaagatcgaaggaagcttcaggctgacataagcttgcaatatat

SEQ ID NO: 119 - skipped

SEQ ID NO: 120 - DNA, 484 bp, Artificial Sequence
  Synthetic
ctagagcagccacgtgtagcatgaaacccatgacaacgtttgcattgttgtattggttggcatggtttgtacagtatagcgactcctgattcgtcgaatagtcggaatccgggtcatggagcttgttctcgggaaaaatgtgccagccaagagcgatgtggagcaccagaacgagtcttaccatgtaccctaaccatcttaggcgcaaagttagtgactttgataatttcggctacaaggttagtatcgtcgactgtcacacttccactagaagtttgacgggcaacgggaacagttgcaatacgatatgtaataagatcagacgccggttctagcttggcaccctgaaaagatattctatcactgtcatttagtagcttttgccttatctccttttctttgatagtaagtgcgaagccagtgggggttcgagcgatgagcgtcacatcagatggtacacaatttagatttttgcacaatattt

SEQ ID NO: 121 - DNA, 588 bp, Artificial Sequence
  Synthetic
gcttttcaatgtcgacctgcaaactacctttggcaacaacttgattcaaaattatattctggaagctgtttgagcaaggagagtatagccgatattatatatgctcatgcatctataagttgtttaattgactggatctttgggatattaccgattttaattctctggaaactcgacatgaagttcaagaccaagctctctataatgatcgttctttcattaagtatagtagcctctatagctactgttatacgtattatttacctccatattcttaagaatgtgtcacaatccggttgggatggttttggattaataaaatggtctttactagaaccagccattgccttgacagctgcaaatattgcaactctcaggccacttacgcaaaagttattttcaaaaaaacgacgaccatctaaatcacaaccacctaagctttctctcaatgctattcggggcttaagtcggaagtcttcagtatgttgttcaagtgaatttgcagatatgttagggctagcagtatcacctggcgtgaaaactcgagtctatgctgatagaagacttgataacactatccaaaaaaga

SEQ ID NO: 122 - DNA, 403 bp, Artificial Sequence
  Synthetic
caccaactgggtgtcagtactaataccaacagttccagctgttttacataaagaacaaggagtagttgaagtgagcaacagcatgcttgctgatgaggtggaacgtgtctgctctgtgcggccagctcacataaagctttatggaagaaataaacctgaggcaccgtatcgaacatggatggctttcttcccgaaagctccacgcggcacttttaaagtgttcgacgaatctggaattgcgagcgaggtcttttaaaaagcagcaacctctcgaattttgtaaaagatgcaatgggcaccactctattaaaaattgctcaagggctccttcgtgcggaaattgtggctcgaccaatcataccgaggatttatgtatggccgcaactaagtgtagaaattgtgg

SEQ ID NO: 123 - DNA, 383 bp, Artificial Sequence
  Synthetic
aaaggtagtggctctgggtctggaaaagggaaaaatgtagaaaagaatgttgctgttgcaacccctaaattaccaaaacctccccaaacctcactgaacacatgggttactgtggctcgaaatggtcagaagaaggcccgagttcttcaaaataataatatacacaccaccccgatgagtaaaataagaccacgagtatcaattgtggagagagcctcagctgctccgacagataataggctgtttctccgtctcccccaagaacatgaatggcgaaagctttctcctgctgaaatacgtaaggtaattttaaagaaactttcaatctcacccgtattggttgggaatacgtgaggtaattgtacattggttgggaaaattaa

SEQ ID NO: 124 - DNA, 392 bp, Artificial Sequence
  Synthetic
cacaaccttgggtctgtccttaatttttccaccaaataatcaatcctacgaccattgcgtgggacaataattcaataaggaaaatttaaataaaaaaaaatttaaaaaaaaagaaaaagaaaaaatttaattaaaatccataataaatactctgttaatatttacaagggaatcttaattattcaaccaaccaattatctcggaaaaggataaaggagttggtttacatctaacgattagaaagcctttgaacctagtatgcccaattctcttcatatggatacccagtttcactcaaacaatatgaatagcagtacagcgaattatagttcattgcctagcatttcgcctcatcaactgcagcagcaaaatcaaatgccgactcatattct

SEQ ID NO: 125 - DNA, 371 bp, Artificial Sequence
  Synthetic
acgcgcggctaatgatatgcacaatgcacggtgattagtagcatagatagtacattagcgacttttacaaaagaagtagagatagaagaggctgtagctttcaaagcgtacctcaaacttgcaatagcaaactttgcagcagtagattcgtcccctcctccacctcgtgtcccattacatacaagaccgaataaaggtaacggaaatgatagcagtaaagggaaaagtaaagagaaaaacttgtcaaagatagcagtcgcaatacctcgtattgcttgtaatcgaattatcatgggccacagtaatcaaaatccaaatctgggtacgatcaaagaaatagaattaccaaaaattattaaaaatatgatata

SEQ ID NO: 126 - DNA, 521 bp, Artificial Sequence
  Synthetic
aaaccgaaatctacgacaggtaaagcatcacgcaatataacggcgaaagcccacctgctatcacctactctcaacgtcctacgaaaagatgttgttttcgagaaagcgctcagtgacatgcatggctcttccgataaatacctagataaagactctagcatggaaattaatataggtgatgatatcagcgaggggtcgaatgcggatccctttgcagaagaactccccacgccatcaatagcgccagatactgcggtagctaccacacttaacttagcacatggacaggacgtgaaagataatcacaatgcggctagtctcatggatgcaatcaaaggcctactagacttgacaaatgattacttaaaaaatcttgaagcacatcacccaggagttggggcagacttcttagcgcttctagcggacggagcctcccgagctatgcgcggagagcgagtttattctaatacatcaaaagtatgcgaaggtagaaaacaaggaacacaggcaacatggactga

SEQ ID NO: 127 - DNA, 598 bp, Artificial Sequence
  Synthetic
tcgttatcccggattcatcgaagactctgaatccacagcgaggagcttccgagaatagagcaagccaggtcctgtgaggtgcttctggatttgtagtaccgtataattttacgtgtgctggacgtttagatgatacccgctcaatctcattcatgagcattaacttagatacttcaacctgaccatctatggtaataattttttttggaactgtaggcacaaggactgaaatccagtaggggccaggctctagtgacgctccggacataaaaagccctccggaagcggaaagaaggtcttcactatatttcatgttgcatgtagttatacaagccctgatcgccggagatcttctctaaatttcatgttgcatggagttaatgcaaaccctgatcacactggcttaatgagacctatagaggctggggagaccgacaaacgtttgagtaccacctctcgaaagcccgcaggagtgctggggagaccgacaaatgtttgactattacctctcgaaggcctgcaggagagagtttacgccattcatgatctaggggaagacgaatgaatagtctgttgtctgatttatttttgacctcta

SEQ ID NO: 128 - DNA, 598 bp, Artificial Sequence
  Synthetic
cttcaaatgctggggtttctaaaagttttatcaaatactcaacagttgttcgaaagtctcctcgaatacttaattcctttagggcaaccaccatatgtttgcgcgaagctgatctattttctccatatgcaaaaatatgaccaaattgactgtctgagaaactatgaataccgccggctgtaccgacagagaagtatccccagacattcgaactacttcggaaatttaattcatgcatcataccgcttgatggtttaaagccttctccaggatcttcagaagtgatacgacaagctgttgtatgtccttttggtgttggccttctctgagtttcagaagaggattctttggcaaaatcaaaatcaatttctgttgatccttgagggtcgacaccatacaacaatcgtatatcacggattctatgtagaggaagccccattgcaatttgtaattgtgcagcaggcaaattgacaccactaaccatttctgtggtaggatgttccacttgtaatcttggattcagctccagaaagtaaaatttatcatcagcatgtgaatataaatactcaacagttccggcagatacataacccacaag

SEQ ID NO: 129 - DNA, 549 bp, Artificial Sequence
  Synthetic
cttgcttgaaattcttctcgtggaatttcttcaagaagctgagtatccttgagactagctctaacaggtaggggaaactttggactatccagataaactttctgataatgcgccttaacttcgtccttgtctcgataacctccaatatggtctgctatatctgcccatgatccaaagccatatatttcggctccctccaaaagaagtaattcttcatcagcaccccagtttctgtcatatatgggaactgaattttgctctattactcggtatggatgggttcctgggttgtggttgtgtgaagcttcgccatttgagaagcatagcacacaaagatcataatcatgacagtgagggtcagcacacctaattcgaactgtcgaggtaatgtctgctgagcatacatcgcatacatacttaacacctccctcggcacctcgggtcgcagtcttcttcctgatttggcccattgctaaaactcatggtcagtactagcaacagagctccccttggtagcacgaagttaaaactgcaaatccttaaaatttt

SEQ ID NO: 130 - DNA, 576 bp, Artificial Sequence
  Synthetic
gccaatgccttgagcgtctgaacaagacttccagtgagtggtctaaacttctctactatattctcttcaccttcttcatcagcttctatgtcggcctcgcaaaggctagtgacaagtgtcaagccacaaaggagaactccatgatttcgatctgaaataagtgtttctgctttttcgaagaaatgctcttgaagatctggcactttcttgcaaatacgcatagcacatagagcagccttcttacgaatatatgggtttgctgtggaaaggagattttctatctctggaaagagatctcttgacatttcgattgatgcgatgttgcctagcgtacagagggctagtccgactatgtattgattagagtgattgagatcgttctttaaggagtttgtaactaaggtaagaacctcttgattttcgtctaaaagcaacatggtccctaagtaaccaaggcgtttgtcggcgaaacgaggagacgcaagtaatttaaggcattctatctggccaaagtgggttctttccccaagtgtgaagagatataacaactttgcaacgttattacgtctgacattg

SEQ ID NO: 131 - DNA, 595 bp, Artificial Sequence
  Synthetic
aacaccattaggccctaccaaagctgttcgagagtccatatcaacacctagatccaaatgtctgtataaatcatctttaggatcaccagagtatgaaaaagtaacatcgtcaaatgataacactggtggaggaagtttttccacgtctgcaaatctgaaagtaaagatacggtcaggctcaactttttgaatgaagccatctgcttccatcttgtctagtattttttgtcgtgatttagcctgtctgactaagttggcataagtaccagcagatgcaataaattttttgatatgagcgatttcgtcttgttgcttgtgataagctttcatttggttgacttctaactcagagcgggtcttttggtatgtatcataatttccaccataatatgtaagttgtttttgccgcatatcaatcatattggtgcagactccatttagaaagtccattgaatgagacactaatacaagacttcgatcccacttcttaagatattcttcaagccacacacaagcttccaagtctaagtgcgcagtcggatcatcaagtagaagtaaagatggcttaacaaaaagggcttttgctaaagctaca

SEQ ID NO: 132 - DNA, 466 bp, Artificial Sequence
  Synthetic
cttgtttatttgcaaacactagaagcagagactccttcatttctcgatcattgatgatgcggtgcaattcttggcgtgcttcgtctatacgtgctttgtcggacgagtcaaccacaaaaatcaagccctgtgttccgctgaaatagtgtctccataaaggcctgattttgtcttgtccacctacatcccagacattaaacttaacgttcttgtacgtgactgtttcaacgttgaatccaacggtcggaatagttgtcacatcttggttaagttttagtttatacaagatagttgtcttcccggcagcatcaagtcctagcatgagaagcctcatttctttcgaaccaaagatctttcccatcatcttagaaagttgaccgcccatggtgaagatgttaagttccgaggaccagagaaaactcgtgtatcctgatcaatgaacaatagcaaaatcttgaatacttat

SEQ ID NO: 133 - DNA, 532 bp, Artificial Sequence
  Synthetic
ccactcccatccacggcactacatgcaactatactccaatttcggtctcttagctctccaagtttcaaggcttcacttatttctcccgcaccctttgcaccaggctgatcctgtttgttcgcaaaaaccaataaagctaatcgatcaatatctgttgagtctataacgaagataactgcagcggtattggaatagtagcaacgccaatatggtcgtatagatgtttggccaccaagatccgcatctttaagctcgtcttcattgagcattgcagcaagttcgtcatacacgtttagatgacttagatgaagagaaaagggggagaaagaacaagctttaggcttacccaaacattaaaatttaaattcttaaaggtgatagattccacattgaatcctattgttggtatcgttgtaacaacttctccaattttaagtctatagagtaaagttgttttgccggcgttatccaagcctaggatcagaattcttatctctttctttgaccacactaatgatgatagcttagaata

SEQ ID NO: 134 - DNA, 562 bp, Artificial Sequence
  Synthetic
caccgcccatagctccttcaaaaacgtgtttgacaaatccctctttgattcgtaccacttcaacgcaatcttcacgatcttgcttatttgctaatatcaacaatggtacaccgtcaatttctccattgaccaagacttcctccagagccaatcgacactcttcaaggcgacccgactcatcatgctccaaatctccatcaccaatctcagtgctatcaatgaggaaaataatggcgtggcatgatcgatagtaagatttccatagtttgcgaagagattcctgaccacctacatcccaaagcttaaggtacatgtcaggcagcgtaatagtgctcacattttgtccgactgtaggtcccgtatttattttgggtgcaggcgcatgaggcaggaacaggaatttaacttgttcgtgaaaagttgtcttgccggcgttatcaagtcccagcaaaagaaccgagtattcttctttgcgcgttgcgtagtggtagagacccttaaccaaatgatacatgtaggtttagatctacataaatggagaaagaaatcttaattagaatgg

SEQ ID NO: 135 - DNA, 568 bp, Artificial Sequence
  Synthetic
agaccttcgggtactgctacaacaattacagtgactgtcacaatgaaaatttgcagaaattgctgacctttaacggttggtgtagcatcattgttaggtagtctagccagaaactcaatgaataagactgtaaataataatagaccagctcctcctccaagtttagctatatactctgctaaattgttcaattttgactgtaatggcgtgatttccggatcttcacggagcgacattaatgttttcccataactagagtttacaccagttgaagtaactaaaaatgtacccacaccttcagtgacagtagccccagacaaaataaatggatctaatttttctagcttttcgtggttcgagatagcagcataaacttggtctgccggatgcttgcgaataatatcggactcgccagttatttgagactcatcacatctaagattatgccctccaataaaaattccatcaacaggaatcatgtcgccaggttcaagatgtaaaacatcgcctacaagaacatcatagatggatatttccgaagttttcccggaacgagtcacatttacat

SEQ ID NO: 136 - DNA, 596 bp, Artificial Sequence
  Synthetic
tgttaacaggtataccatccaaatgaccatttacacctgcgtaaattataggaaccatttcgttaacagccattggtgaatattgcttttgtttcaaaagctcggttaatcgttcgcctcggttgagtgtttgcttagtagcagcatccaagtcggatccaaactgggcgaaagctgcaacttcacggtactgtgctaagaatagcttgagcgagccagcaacttgcttcatagctttcaactgagcagctgagccaacacgagatacagaaagaccaacgtttattgctggtctgatacctttgtagaacaattcagcctctaaaaatatttgtccatccgtaatcgaaataacattggttggaatgtaagctgagacatctcctccttgagtctcaataattggcagagcagttaaagagccacccccgtgtttgtcgttcatcttagcagcacgctctagtaaacgtgaatgtaagtagaatacatcaccggggtaggcctcacgtccgggaggtcgacgaagaagtagtgacatctgacgataggctacagcttgtttagataaatcatcgaagacaataacagcatgtttt

SEQ ID NO: 137 - DNA, 598 bp, Artificial Sequence
  Synthetic
atcagtctgactgctatactcactaccagagtcactgattacctgtctgtctctatcgacaattccatgaggtgattttaaatgagtgatatgttcgtcaatgacacttagagtttcattcattacagggctatcttgacgatgattcttaatattaacagacgagatactttttgattgaatcgttgtttcaggactagtaatcgttaagtttgacggagccttgataccccggggcccaagagttggttgtatttgaggagtatctaacattttgagaggttctgatggcaaggagaccgtattttcaccagaaaaaggagtttgtggagaaactgtgttgctagttttccttattttggaatgggaattttgaatggacgatgatgctggcgagcatattaaagatcctcggggagctatacgtgtgtatacttctgggaagaggccactctttccatttagcagatgacggcctaaaaaccatccgtccccaaaatcatcatcacgttctatcaactcaacgcgatctcctttggacaagctcaactcatctgagctacgagctgagaaatcatgaactacaagcaaaatatga

SEQ ID NO: 138 - DNA, 598 bp, Artificial Sequence
  Synthetic
atcgtgctgtgctcgatatgaaagaacgagtgacgaaaaatactagtaatgatatacgtgttgtgaagaagaataggagaaattttagtaatttttacagaatcaaacatggacgatgcttccttttgggggctggaggttctaatgccgccacaatagcctcatcgaaaacatcttttaacttgtattgtgtcaaggcactgcactctacatattttacagcaccaagatcttttgccattctctcaccatcctctcttttgactggttgcattttttgtttgcttaatttttctcggacactaggatcgtctcgtaaatctgtttgagttcctacaattaagcatggtacgcctgggcagtggtgatgaacctcgggaaaccatttctcacggacgttttcaaacgaggcaggagaggtgacagagaaacacacaagaaagacgtcagtctgtgggtaagaaagaggccgaaggcgatcataatcttcttgtccagcggtatcaaaaagacccaatgtataaggctcatcgccaatcataacagtaactgcatagttatcgaataccgtgggaacatactctgagggaaatttatt

SEQ ID NO: 139 - DNA, 597 bp, Artificial Sequence
  Synthetic
gcttcgcgaaagtaaggtgcaaggaaaacatcaaagagggaaccagtaaggccttcaacagtatctgcgataggaagaactgcgatacgtttggcgtattttatatcaggacatggatgtactgtaacaatatcaccatgtttaaccctaaggttgtgtcggacaacacgattcatacgagcactcccgtcatctaaatcatcatctgcgagtacaattaaaacagtatcctttcgcttcttccccttaactaggacagtatctccacgaaaaagctgcaaagtttccatggtattatttgacagtgcaataacagagttatcatcgttgatggcatctgttacaattaaggaatttggctttttcttcttttttaaaatagcagtcgcagtagcatcaatcgtcttttgttcagcgccagaggcatcctcaagtttaactgtttttttacgagtagcattgtcttcagacatagttgtgtaataaaagttaagagggcgtaatttcctagaaagaatatatctactattaatttattgagatcttggaatgaaggtttatccgataaaatctgtaaatgatggagctaatctgaag

SEQ ID NO: 140 - DNA, 537 bp, Artificial Sequence
  Synthetic
tgctacgcgtatatgaggaatagctaagaaagggttggtgtgcaaacaaggtagaaaacccgttgatatttctaataccttgaggaatactgcggaatatatacgacaggtgttaaatcgactcaagctagatgatcaagtaaaattaattattcaatttaacgtattttaatttgatagaaatgtaatccagacaaaagaaatttctagattacggattatttgctcagctgaccgatcagctttctagtaccccgtctagtctaatcagattgacagatcagagactatgatgatcaaaattggaccgacactatttttgagaataaattatatctaaaagttattctactgcggtacaggatgtttacttttaaggttttcccatcgcgaagtagttaaatattgataaaagacgtagtagataacaaattttggtgagagaagtttcaaaagcggttctttttgtgcttagaatacagttatgtaaaagacgtgatcaaatttaatcgtaaagactatcatcgttaccagcat

SEQ ID NO: 141 - DNA, 594 bp, Artificial Sequence
  Synthetic
cgaccgattaatcccattctagacaagccaaaatctgtcaatttaagatggcctttctgatcaattaagagattgtcaggtttaagatctcgatgaactatccctcgactatgaagatgtttgacccctaggataacctcacctaagtattttcttgcccaatcctcttgaagaccgcctaaagcctttataagtgacgcacagtcgcctccattcaaatattccataaccaagtagagatagtctttacttgagaatgtccagtataatttagctacaaagtcactctcaccttgccacatcatgattgcacgttcagctttaacgttagttacctgatttttggctaccatatcggcttttttaagtactttgattgcatagtagtcacctgtagattttttcttggcaagataaacacttccgaatgcacctttactgataggttttattatttcaaagtcttttatggagggtggaacaatacgggcttggggaacaccgacagttgataaacgaggtgatggaggtagtcgagatgggtcagagcctgcagcagaagattgacgtctatggtgatgaggtagaagagca

SEQ ID NO: 142 - DNA, 471 bp, Artificial Sequence
  Synthetic
ctgaatttctgagttccgctatctttttatctcttctttcctcaagtccgtattgaagttcgtgagataatttacttcgattcatctctcttttactttcttgtgcctcccatcccatttttttacatttcatcactaactcagttattggctctatactgttagccccttttgttcctgcatacatctcttccatacaaaattttcgcgcagtctttgcagattgaaatgcctcatcgtaataatttagcgccagttgtgcttgggccagttggaaatatgctttcatatttgatgggaggagacgtaaagcgcattgggcatcttcaattacacgatgatgaagagataatttaagaagtaccattgcacgatttgtataaagtactggattttggggatcacaattgatcgcttttgtgtaaaacatttcagcacgcgtataatcaccagacttaaaatatttatttc

SEQ ID NO: 143 - DNA, 560 bp, Artificial Sequence
  Synthetic
ttgagaagcagccaaccatgtattaacaactaagctagtgcttgcatcaagtttatatgattgcgtagacgtgtaagcagtatggattgagtttaggagagtagtcgatgagacttgcgctggaggttgagaagtagaattgttatttcgaacacctccatacgctgaagaggtagttgaatagatagacatccggtgagttccagtcattttatgaagagtgatcgagtttttagacctttccacgtatggatatttaaggtatgtaaatgagtcaattcaaagtcacaagattctcgatcagtcgattgattggcttattgacaatattctttagccgaaatcttagacaatggcttgacagaattaatgtctggtcttcgaagtatccagttggtgtgtagcagataacttcggtatagttgtagaaatggaaaacaaaccgcaaaagacagtcttgtatcgaccgtgaggccgacagtaggagaaattcaatgctattgagaaattgaacaaccaaaaagcgaaagtagggtaacaagtttcgactcacagaccta

SEQ ID NO: 144 - DNA, 593 bp, Artificial Sequence
  Synthetic
atagctcgaaagcgatacgcagagaaagctccgggtaatacacttacataaccaaatgaactttcaagaggcttatccaatatattactaattttgtactcaaagttttgagcagcaactagtggattaaatagtttgcgacctcctttacccaacattgcgtggatttccccacacgcgccaccgagatctttatcgttatagaagccttcccatagcgccaataaagattttgttccgggcctggttccagcatcaagtaaaatacatacttctggattaagtaatcggccaaaagcattaaatagccatcgatgtgaatttattttcttgctatttttttgctttaagcaaaacatcatctggacaggaggcaatgtattagagctatcatcagtaggtcgaatgagttgttgattagctgtgacggataactgtgtagtatattcaaaaatgtgggcaactgtctcttttccgtctacatcctttttcattacaccatcttgataaataccaatggtggctagaacatctagagtatctttatcacagggatcgattccgtcgaatactagacatacaacaattttttg

SEQ ID NO: 145 - DNA, 593 bp, Artificial Sequence
  Synthetic
ctgatgctggtctttctctctcaagcttgaagaccataacgccattatcatgtccggctgcaaacaaattaatagttggatgagctgcaatgacccaaaatcgatcattctcccttttgaatgactgaacagaagtacgtttatttaagtcccaaaccctaatagttttatcttcaccgacagagagtatcagatcctggtgaggatgaaagagacaacaggatgcattttgaaagtgaccacggcaagtatctacttcccatgcttttgtctcactcattcgccataactttacaagacgatcatcaccagcagatacaatcaatggtaaggttggatgaaaagcaacccagtttacccctcgatcgtgaccttccagtacaaactttacaaccgcgtctgtatttccaaacatatctgcctgattctggttacttcgtgacatctggtcttcgaatgtcattgagttaggtgccgagtgctttttgcgtaaccctgaaatatcccagacacggactgattgatctagagaggccgacacaactaaatcatcttttggatgaaattgagcacacatcgtgtagtgattgtga

SEQ ID NO: 146 - DNA, 451 bp, Artificial Sequence
  Synthetic
gctctgagttgagaggcattatcagtttgatctatttcatcaatagggaagtaagttgtatcaacgtttgatgatagtttaggttcaaaaggtgcacgaatccttcgaagactatcaaagtctacaccacggaagaactgatgtgccttaatctcatcagcacttccccttcctagccgattttcagtattacaaataagacttcggatcaaattttcagcttctggccctaattggacatcatctgggaagtaaagagtatgtcgccagttaacaatcttacgataagtatcatgagaatcctcagcgcaaaatggaggccatccaatttgacattcgaacataatcgtgccaaggctccaccagtcacagtcctgaccataaccctgaccaagaaaaatttcaggtgctatatagtcgggagtaccaacagtagaatatgccatggttc

SEQ ID NO: 147 - DNA, 554 bp, Artificial Sequence
  Synthetic
ctcaaatgggatcctcatcgatgggacattggatcaggtaaagtcctaggaaatgatgcggttgatgagaagtatgattatgggtatggtttaactagcacaggagcgtcaagtccatatctaccttttggtgcgggtcggcatcgatgtattggcgagcaatttgccacattgcagctagtgacaataatggcaactatggtgcgtttttttaggttccgtaatatagatgggaagcagggggttgtaaagacagactattcaagtctattttcgatgcctctcgcaccagccctgataggctgggaaaagagatgactgttatcgtaattatttatggcaggtgttagggttagaagaattgtctaaagaagatctacttaataagcaattgtgtttgacaaacatagcgtacttaaggggcttgaaccacaaatcgaaatgcgctaaatgtagttactacccggttagcagtctttatttcaaagtagagacgggataaataagcaagcttaaattctagtgtacgcgcttaggaaccgagatacgaagac

SEQ ID NO: 148 - DNA, 399 bp, Artificial Sequence
  Synthetic
cgagctcttatagtgtgagatctgcagcgagtagtatctactactatgggcaccgaaatcttcgatcttagatagtggtatcgtttgataaccatcgttagttgacgattctgccgccttgtagttttctggataggtccggaatgcacctatttcaaccttaccagctgagatggtgcgatctgggtcaatgacaaccgcaagaaaaggatccgagaatgattgctgtatatgctgtgtgctaacatctatgccactgagccagcagccatagcctggatgactgtggtaccaccccactgcattctctaactttccttgctctcgacatgcctggagataacgaaccatatattcatttgcctcatcttgggcattaacacgtgtctccgtgccttc

SEQ ID NO: 149 - DNA, 529 bp, Artificial Sequence
  Synthetic
ctgcctggaatttgacaacgcatgtaggatttcattaagttgagtgctaaatcccatttcgaaaagtcgatctgcttcatcaaataccacatacttgaccgaggaaaggtctaatgacatttcaatcttaaggtgtaagaagcgacctggcgttgcaataataatatcagggttggctgccataaatctgaattgatcttcaagactatctccccctacaagaagaacgcatttgagatcagtgctccgagaaaattccttaacgactttcaaagtctgcaaggcaagctctcgagatggggatagaatcagagctctagcaccaactcgagcactatgcgccttcaacatttgaatcatcggaataacaaaagccgctgtctttcctgaaccggttctagccattcccacgacatcttgatgatcaagaatcagaggtattgtttttctctggattggagtcggaacattgaagccttttcttttgatggctctcaaaagatgagcatccaaacccatagattgaaaa

SEQ ID NO: 150 - DNA, 597 bp, Artificial Sequence
  Synthetic
gaaggtgtgtgatatggatcatagagttttatataacgatcgctagcacaagttaaaagcttcttatcatttgtccagcacagtcccttaactatgttttcatgtgcagtagtattccaagtttcctctcgacttataagatcccacacctttactacgccatcaccactcccgctagcgaatctctgtaaggactgaggatctttagccatagtatagactccatcaacatgaccttttcctaactgagtaatgaaaggcgcagcaaacatcctttctaatttagtagcattcaaagcccgagtatattctctcgctctttcaaaaggatgtaaagcaggatccaagttgcgaggaactttttggacatcagagccagcttctaccaaagactggcggttgagtgctttaatcttcatttttggctatgtgagagcccatacatagatttgtgaggggaatttgatttctggacatatattcacgagattttgtatacaatactcagtataatgacgctgatgtattgatctaggtgaacaaaaaaattaggtgctttagatggattgggcccgtagatgcgaattcagatgaatt

SEQ ID NO: 151 - DNA, 590 bp, Artificial Sequence
  Synthetic
acctcactagggccttcagtagtttcattaatactagttaaagcatctccgctgttttcttcaccaattggagccattgtatctttaaagggacatcgggctgtaaaatgctctccattacatatacgacatttaactttcttatcttttaatttgtctttcattattcctgcctctgttttttcatctttggcatcttttttccagttggcactcggtctgaaagttatattttcaccaatagatgtggttgagctatctggtccgggttgatctttagcagagagtccaaatttactccactgctttctctcggcaactctaggatttacaatttctttgtgtgtagtgaaacgaattcgtctggtatatttgatcttttttccatcttcatcgattcgataacttacgatagtttgagagccatctttattagttgttgtagttgtaggaggaagttgttcttcaatccggtcaacggaaagatcttcatcgtcggcccagtcagcgcgaacagattgtttagacatttttcaaaatattttaattaaatacttgcaaatggaaagcttgtaaattcaagcaagtat

SEQ ID NO: 152 - DNA, 499 bp, Artificial Sequence
  Synthetic
aacatcaatgagggcgcgggtttcatgagttccaatttgatagagtaatacgggagagttgtcaccgagaatcacaattccgtgatttggagatggaatagggcaatctatcagctctaaagcatagaatttgctttttacgatgggtgacttgtctatatactgctttcggaatttagatgcatatccatcggcgataattgtgagatctcccaaatagtagtcggcttctcttttgcctgttttatcattcattgtctctgaccttacgccaattacagtttgggtttgaggattcgtaatagtctctgtaaccagcgtttcaacaattttgatgttcgggttctgggagcagcatctacggagctgagatattagtctaccatggtgaaaagctcgtccttccggattaccgcccttaatgtttgtatatccatgagcactcgcattatcggtatctgccttgggataaggtattttcacgccagtgccataataa

SEQ ID NO: 153 - DNA, 491 bp, Artificial Sequence
  Synthetic
cacatcgagatataaaacccgaaaatatacttctcatgaatagaactcctactattaaattaggtgattttggcttggccaagatcgttggtgaggaatcattcacaacaagcttatgtggaacacccagttatgttgcaccagagatccttgaagactcagataatcggcgttacaatcgagctgttgatatttgggctctaggtgttgttctttacatttgcctctgtggcttcccgccattctctgatgaattgaccagtaatgattatccttacactcttgtccagcagattaaaattggtcagttcgacttcccatcgccatattgggataatataggagactcagctcttgacctcattgacaaaatgttaacagtagatgttaacaaacgcattaatattgatcaatgtcttgaacatccatggctaactcaaagagaatcaacgactttgccaggtgattactctgaagttcttgacgaactt

SEQ ID NO: 154 - DNA, 404 bp, Artificial Sequence
  Synthetic
taaaggaattgaaggaggaaaatttgatgatggattgataacagacggtacttgcccatttatacgaggtggtagctgataatttgaaaagtgacctaattgattatgtgaagattccatcggggccctgtacgtaaagtggcctgctatctttgagagaccattttgataaggagtttgttgcagacctagataagattgaggaggcggagtagctctcctttttttctctttttcaatagatataccgtcaacgattccccaagtccagccttttccatccttttcaactttgcggaaagcatggtgttgtgatagattgtgacgaacactactttgccagcctaaggtttgagttttaaatctgaaatatgggtatttcctgtatatagctcggtagatgt

SEQ ID NO: 155 - DNA, 424 bp, Artificial Sequence
  Synthetic
atactcaggaggggcaggggaaattaggacagagtcttttgatggctcatttgagttgatttcttcaggtgagattgttcgtatgccaggggatttttcgttagctttctccgtaattttttcatgcggtgacgaaatcagtccagcccgatgcaagtagtagttggctatcttaagacatccatcttcctgtggcaagacaaacatcatctctactcctccaatttcaataatttcgccactagagagtgaaatagaatcaccgcgtttaagaggatgattatttactttgatcccgttacgtccgtgaacagagatgttccatgactctgtgtcagagtcgaatgagatttctgcatgtattcgggatactgtcttactcggaccaagatcaatatgtactgtgttatcgtcttcttggtat

SEQ ID NO: 156 - DNA, 448 bp, Artificial Sequence
  Synthetic
ctccgatctgctacctgaattttgatctccacgaatgtattttctccagaatttcttaatgggctcatacacactaaactgaactgctgcatgactattgccaagcaggctgatgccagcgcccctataaaagcctttcactccttctttctgatatatcagtttgacgccttgccacatattttcgtaggctccgtttttccctctgtcagaactgaccatgcgcgtctttagaacccatattggattggtggtgagtgaaaccatcattcctgagactgccgatgcaatgaaaaaatcaaatggcttcagtaaatctcgttgtttgcttgctttgcatgtatcgtttggagcagcaagatctctagccatgaaaatacgatatctgataatttggccttcaataacagacttgaagccgagaaaaattgaccaactccctgaattt

SEQ ID NO: 157 - DNA, 598 bp, Artificial Sequence
  Synthetic
cccaagagaagttctggagctaaatattcaggagtaccacagaatgtatttgttcggtcttcatctttcatttccattttacatagtccaaagtcgcataatgcaatatggccagaataatcaagaagaatattctcgggttttaaatctcgatagatcacattaaatccatgtaggcattccaaagcacaaagtaattctgcagtataaaatctcgatcgatttatatcgaaccgctgttctttttgcaagtgatggaaaagctctcccccattaacaaaagctaaaacaagataaagcttttcaggagactgaaatgtaaattttaaggggacaataaaaggattgttaatttgagagaggactgatcgttctgctagagtgtgtgcaacttctgagcgagaaataatatgggcttttcgtattgttttaagagcgtagattctttgagtatctttttttttaacttgcatgacttttccaaagctaccctttccaacaactttcaagagttcaaaatcttcaattttaaatgactgtgtttttgtttctcgataatctactccgatccgaattttaccagaaccatatgaaatat

SEQ ID NO: 158 - DNA, 595 bp, Artificial Sequence
  Synthetic
tagccagtatctgttaggcgaaaaaacaagcgcatggatcaaatcaccagcattgagagaatataaatgcttagactcatttagatcccacaacatagtagtcccatctttcccacctgatgcgcagagagaaccgtccggcgagatggtgacagtatttatgtaaccattgtggccaatatggtcagtctgtagtttacaagaggataattcccagaccttcacaagtttgtcccagctactgctgacaatgactggattttgtggatttgggctgaatcgtacacaagatacccaatcattatgacctttttcagtaatggtgaacttgcaatcacctagagtattccagagcttaattgttcgatcacgagagcccgagacaatttgcctgttgtcagcggaaaaagaaacagaaagaacatcatttgtgtggccgacaaatctccttgttgtggttcctgttgcaagctcccagagtcggagagttttatcccaagaagcagatagagcataagcaccatcagaagaaattacacagtcggaaactatatgagagtggccatgaagtgatcgctttgggtaaccgtaggaa

SEQ ID NO: 159 - DNA, 590 bp, Artificial Sequence
  Synthetic
ccgatgacaaggggagatccttttcttgccgcaattacttcatggggataatggactgattttagtagaagtccaaatgctccttgcagctccttgatgacggccttagctaagtccgtaaaagtaattgttgggtgctggtcatatatatacttagcaagcttggcaatacactcagtatcagtctctgtctcaaatttatggccctttgagataagtagggttttgagctctttatagtttattatgattccattatgaacaacactgaactgccatttggggtcactacgatgaggatggcaattcaatcttgatggagggccatgggtggcccatctagtatgtgcaataccagcatgggagtcaaaaactttggagttatctagttgcgactcctggacaagttgctttaattttgcaacctttccaacttctttgaacgcaaaaacttcatctttttcatccccgtcaattgcgagcccggcactgtcgtagccacggtattccaagcgagagagaccgttgacaagtgtttcaagaatgtgtttgcgatccttttcaatgagataattaatatagccaaagat

SEQ ID NO: 160 - DNA, 598 bp, Artificial Sequence
  Synthetic
tggtccggtgtaaaattccttagggttaagtaaaaacatacattgactagttatcatgatcattcgctgaaaatttcaagtcgaatcttcttagtggtggctctatataacacctacgtgtgcggcttaagtagttgaagataaaattttattgatttaattttatttttcattcttttgagcgaataaagacaggatttctttcgagaggcacttgttctcaaaattatttttggccgtggcacagaggatttttttttttcatcctagtagataatcaaattaggtagctttggcagctttggccgctctaagcaccttctttctttgagcaatcatgtgggtgaataatatatatgaacctggaatgtagatcaaccgagttatttggagaaaccaagcaaaattctggtgaagtgtgccagcaggtgcaatggctttcgagagtaaccaacattcgctactaatgccaagcgggtaaagaacgtaaaaagtattatagcggagccacataattatttttgggttatagccactgagattgaagacgaagtatgaatatcggataacttcggtcacactccaagcaatcaacata

SEQ ID NO: 161 - DNA, 597 bp, Artificial Sequence
  Synthetic
ttattggtggtagaatgttcaaaacctctgatataagttcatagtatttttgcttggattttttgttgagactcctgaagaatgaagcgaaagcttccatagcggccagtcggactgtcacgtcatcatccttaaatcccttggtaaaagcagaaagaacagtatcttcatgctgcttttcgattattctaggagttgttgagaagattctataggcaatctcacgttggcccatcacttgcgacatactgagtgtaaagagaacacctagaatttcgggccattgcaacttatcatcggagtactgcctagcgacttctgcgactgcatcacctatcttatttcttgtagacgtttcggtttcagagctaagggcttcaagaagtttttgtctgataatatgtccttgttctgtcggcaaagagataaatgtttccactgactgattattttgtaattttcgagtctttgaagctatccgtctgaagatgactgcagcaaaagagcgtttcgcaggatcgtttgagccctgaatttgttccaccaggccaatcaagagcatctctggtttaagcaacgtccaattattcgttaaat

SEQ ID NO: 162 - DNA, 598 bp, Artificial Sequence
  Synthetic
ggtttgaggaaatgccccataattccaaagatagcctttgtggggaaaacaattgcgaacaaatcgaagtttcccttttttggtatcctgttttatcggattaagggcttgctccttgcagatttccaattttgcattagtccatctagggatttccacaatcatgtttagtattgtgccctcaggattagcgtagagtggtatatcatgaaaaggtgatatcggatttccatctctttctatatatattcgataatcaagagtattgggctgagcaatcttgcgtatggagtattgagaagccatgatgttagtttttttatgaaaaactcgaaggtgatttgctagttgagtggaacgtgatatagcctgagataaaggcgccagggttgacgagacttggatagaaatgagttaagctgttagtattccaaggcgctgtggtttatcattggaaacgggaatgcacattagtatcataacaatgcctgtctgtttaattgtcagtcagtcagtcagttagtcacgtggggcagagagcaagctgcgcgttcacagctagctgacaacatggagcctgctttaatttaattctttg

SEQ ID NO: 163 - DNA, 526 bp, Artificial Sequence
  Synthetic
atatcgggaggggtggcggtaatgaggaaggctcttgagctgctatgagagatggtgatgattgtgcctgatgtactggaagtaatggtagtgatgatgtttgagtaacacgaagagatgttggcgatggagctggagaaactgagggattttttggtatttgagagactgtgaaagattgaggttgtggactatttggctctctattcttttcacagtctcgagtagttatttgaacactaggacgtaacgaggaaggaggcaaaggaggtgttgctgatgcagatactatcggaatttttggaggtaattggggaggagggagatgctcacttttagcaagaggggttgtgacttgggaagaacttgtatgaaaaacacgagttaaaggtggtattgtttcacgtggtggtattaaaggccccgcacgatgtgaaataaaagatccagtgtttttctcacctgaaaaaggtggtggtacgttgaatttagagacgcccgattccgaattttctttagaattttt

SEQ ID NO: 164 - DNA, 595 bp, Artificial Sequence
  Synthetic
ttttttacagcctctttgggaaatcttatggattgaggcgaaggcggaacttcattatatatgattttgcaaatgtgtgaaaagcttgagctcgcacctttctttgtttcaaaagctagccgaacccttatgacttctaagggatatgtgaagaaaacactagcgacgcctgctaaactgccacttaacaatcttcgtaatgatgtttcttgcgtaggtgatgatataagaaatgatcgtatttgctcgtaggttaaaaacttgatcgcagcataaggaaatatccgaattatagtggcagaatggccacgaaatagaccactaattccatcagtagctttgatttgccgtatagcagtcacaacgccgagccagctcccagcgtatctggaaaattgtggattagaagattggaataatatcttcacacgatctaaaggtgccactatagtttttgccgcactccctgctagtcctccagctaatcctgaccgccatatgaatcccaaagattgcttttcatgagtttgggattttgatgaatcttttttatttttcgtagaagggtatactgcaatattactttcatataaat

SEQ ID NO: 165 - DNA, 598 bp, Artificial Sequence
  Synthetic
tctgtctaagagtggtggtgaaatagtatccagactatttgcagtagcgataaacagaactttgctaaggtctactggaatattgacgtagtggtctgtaaaactgtgattctgctctggatcgaggacttcgagcattgcagcgctaggatcaccttggaaattagaactcccaattttatcaatttcatctaaaagaaaaacgggattgcacactccaactttcttaagcccttgaattatgaggcctggcatagctgcaacgtaagtacgacgatgtcccctaatttcagcctcatcccgaacaccaccaagagaaattcgatgaaatttacgaccaagtgctgttgcaacagattttgcgaggcttgttttacctacacctggaggaccaacgagtagcaagataggcgatttatcaaccattctctgactttttaagatttctagtttttcatgtgctctttcttcagatgccttcttaatcttgatgtcaatgtcttgatttattgattgctttagtttgagaaccgctaaatattcaaggagtcttttcttgactttctccagaccataatgatcatcatcaaattgctta

SEQ ID NO: 166 - DNA, 517 bp, Artificial Sequence
  Synthetic
cggccccatcgaaccatactttttgcaaaaagatggcatcgcatagaattgagcaagcaagagattatcgtaaccttccataataataccagttgagatagcaacactataaacagcagctggccaccacaattttagagcttcgttgacagtcatattcttttcaagctcttccgcacgatgggcaccctgagtggtatagtactgactcttttccaaagaaggagctcggccaatgtcctcctcatgcttggcagtagtttcaagaatggacttgtcgataatagacattttgagagttgagaagtcaaaaaaattttgaagtaaagatcagactaaaggtgagtttggggatttaaaaaaagaatattagggtaaggttatgattgagttcacaagggaataggttttctagaaagagcatgaaggaaagacataaaacctgagagtgatatttggataattttgaattccatcgtcaacagcttcgggagacaagtctttatagaattctgat

SEQ ID NO: 167 - DNA, 529 bp, Artificial Sequence
  Synthetic
ttgagccaaaataagaaacgacacgtagctttggagcccattttttaatttctcgacgccaattaaggcaagtcgaattaggagctacaactaaaaagggccaacatttcgagtgatttttgacaattgctacgataaaggcaataatttgtattgtctttcctaagcccatctcatctgctagaataacatttttcttttgatggaagttataaagtagccaatttagaccttccatttgatattgcatcatctttcctcctgtgagttgtagaggttgctctttcatctcaactcttcttgaaaaatttaattttcggaacatctgtaagcgatggtccatagctgaagttgaggattgcctaaagtattttccatcaataaattcattataggcggtaataaagctttgatatctttcgatattctcaatttttgggggctccatccatactgcttcatcataagcaagacctttgaattttacaaagacttcagtgatcatattagcagcagccttgtctatctt

SEQ ID NO: 168 - DNA, 483 bp, Artificial Sequence
  Synthetic
aaagctccagctgagcaatgagtaagtggatcgtaagcctttgatgggttcagaaatgtagatacagattcgtatgcgagaagttgaagtgctgtaaatggtacagtcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaatgcgcatgccccacttgtaactatgtagcttcagtaagtgctcaatatcaaggataaattggcgatgtagtcatatatgtctgattccttaatcaaaattcttaatacagacctgctgcaataggatgatgagctcctgtttgattacctcccatgagatgtttgacagcttcataggttgcaaaata

SEQ ID NO: 169 - DNA, 598 bp, Artificial Sequence
  Synthetic
tccagcccaaaaaggaaggaaatgatgtaagctccatgggaattcataacctgagtgagcatcaatagcttggaatagtcgacagataatccaacaatacatcgtaactaagtgaagattgccagttatcagacaccatacagttggcattaagactgttcctgcgccaagaaccattgtttctattggtgaagcatattcagctgctagtccgaagggtgcagagtaatgatgatgtattttatgaatatgtttgtagaaaggaccccaatgaaataatcgatgcatccaataatgccacgtatcttccaacacgaaaaagaaagcaatctgaagacacatagtttttaatgatggaaatgggacaccaacatccataccacaagcctttgtcaatggatgaaaaagccaaatttgaggcagctcgacagtgaaatgacttattaagaccagttttgtacattcccattgttctttggcagttggaattttctgaccctgaattttatatttgttgaaatatggtatatatcctatgatcacccatggaatacttcggccaaaataaacaagttcatgcataacaaaactcataata

SEQ ID NO: 170 - DNA, 511 bp, Artificial Sequence
  Synthetic
atttctcattcgcgtagttgatacagaattgctcgaatgagttttttgcaaagtgttcgaatccataaatatctaaaactcctataaatgacttgacacggcttaagacttcttcagcagccaacgcataattgatattttcaacaagccagtcaaaaagacttgaataaacaaatttagcgaccgaatctcgaacaacaatggcttgctgttggcttaagctactaacgactttatctccccgggtaattaattgcttcttgactgtccatctagcaaattccaccggatcaatgcccaaaattgaagcagcaatctctagagaaggctcattaggagtaagtgaagattcatttcttgtggcagtaatcttaacatttccaagatgtagtaatgctgcaagtattttaaatatttcggtctgctgatcctgtttgactccaattgttgctagggactttttgagtgcttcgaattcggctttatcatcaactccatctattgaaggtga

SEQ ID NO: 171 - DNA, 473 bp, Artificial Sequence
  Synthetic
ctcctcgtattccacttctcatagcgactatgaagaatccatcaacttcaactttacaaaaagcaatacatgcactttcacaaactacattcgtcgcggaagtgacatctcctgtgttagctctccttacgcctttactagaaagatctctcaacactccatcaaccactcaggaagtccttcgacagacagtggtcgttgttgagaatctaactaggctagtgcatgatcctgttgaagcacgaatatttttgccaaagctgaaacctggaattagaggtgtaatagatcgcgcttcactaccagaagttcgccaattggcacagagtgcgctaactgttattgataaggctatgggcgattataatggtgctactgctgctccgggtatcatatcccatgtcactccacacgaggtttctctcattttagaaactcatgtaaaaaaaacaagctctatagttgatactgat

SEQ ID NO: 172 - DNA, 598 bp, Artificial Sequence
  Synthetic
cgatgccacatacgacttgcagtttttaaaaatccaaataataacagctcaaaatctgtagtttctgcgtcaaagttgcgaagtattatacagatcattggaagaccatctttactttcgccaccatcataaagtgcacgagttgatacaagggactcagtattccttccagaattttggagcataaaatgttgaaatcgtgaatatgatacaggactatttaaggagattactgggcggttccaggacacatccattggtggtggtccaagattcgttatgagcctccaaagcgcttcagatattgatatctccactacaccagaatctgtcgacggggctattgctcccttcctctccagaagtcctactttttgtcgaacatgatcccagttatcatataagaatctatgcaaagcaacgcatgacccaaagtcaaaagattcagtctcgatttcagtctctactgcactaggtgagaccgatatctcacggagaaacgttgtgaccctatatatattctgagtgagaaaatcattaagtggaaacatgtatggttctttagcaccaaatagaacattgttggcaagattttgaa

SEQ ID NO: 173 - DNA, 598 bp, Artificial Sequence
  Synthetic
tcaacggatggttggtcattagtttttagatctggtgtagacgaagagtctatcttttttgaaatagacggtggactttcaggagtaggaactaaatctgttgttgatttatacgataaaagattccgctctgttcccatagatggtgcagaagaaaaaagcttataggaattatctgtcatgcgtggtaacttccatgggaatctccgtaaagtcatgcagcagtaaataatcgcgagtgaccagatatctgctggctgtgggtcatattttctctcttcgtaaacttcaggagcgagatacggatccgatcctacaataccacttgctttagttataccagattcaaaaggatatttgaagacactcgcactcccaaaatctattatcttcatgataccatgctcattgaccactacgttgtctagctttagatctcgatgcgcaaggcccatacaatgaaggtatgtgaccgcgtttaaaatttgtaaaaacgaacaagttatttcatttttcgacatctttccggtcataactattgcgaaaagatcatatggagcgtattccataacctcgtaccatttttctttttcgcaaa

SEQ ID NO: 174 - DNA, 597 bp, Artificial Sequence
  Synthetic
caaccactgagacttgttcaatacatgatacacaatagcaatcactatcgtgacagcaatagaatagccccagacaacaataatagtgacaatggaggttcttccgtcagtagataaaagggagtttaatgtggcaggatctgaaggctcaccagcaccgccagttaaccaaccaaagagacagaagagagttgcaagtacatcaacaccgaatatagcagcaacgagtgcaaatgcaggataagtctcatctcctctggtgacaaagatgagccagttttcggtgagagaaatttgaaggaataacattccctggatagatccaaagttatcaatcatgccaccattaggtaagaaaagcgagccacgtaatacccatgttccaagagcaagcaatatgccaagaacaacagagataatccagattttaggtaattgccactcaacaggtcgaatctcaaagtgagcgttgtcgtatgcaactgcaattgtggctaaatcggcaaaaagtgcaaggaagacaattaaatcaacccggacagtttcgttaataatgatcatagaggttacaagatagatttctaagtgtaaacataa

SEQ ID NO: 175 - DNA, 558 bp, Artificial Sequence
  Synthetic
ttcctgtgtacttccgttgtttaccaagactttctacaaagtcttttccaagcactttgaggaagtcgttaccaaaaatctgttgcgcatagccctcaagttcttgaagagcttttgatggaggatcgcgtttctctttctcaaattgatctgaaacatcacagagaaagtttagcctttttatgggcgaccaaaagaagggatgagccatgacttgatgagcttgcggtcggcactttgggtctgaatcaagcatgctgcctataagttctttggcttcatacgcatagttacctagaatctcaaggggattaaggtcatacattcctttcctaatatttacttctctcataaagcggtcgccacaatcaaaagggtgattacctctggtgagaacataaaaaaagataaggcctagggaaaaaatatcgatcgcccgagtggcacgtggattgagtaaagatccatgggttagtagcttagagtcggagttgttctccgcacatatatcagctaaatcagattcttcatcttttacgatttcacttaggagtaatt

SEQ ID NO: 176 - DNA, 460 bp, Artificial Sequence
  Synthetic
ttctttgttagacgtatttgattggtaagcccaattaacgcggatttctgcttgatgaacacgtctgccattcaatgtttgcatcgctcgctcggcagatcctggatcatcatactcaacaaaaccataattaaatcccttagaagcacctacgttcttatcaggaataatcttgacgttttgcacatgaccagttgtttcgaatatttgtcgtaaaacatcctctgtaactcggggatctaaacctcctacatagagtgcccttttatttggctcaggagccgctctacgagaaaaagctccattattgttaggtgaaaccacagtcccgttctcacctataggcgatgtgatagctgtcgggattgggttcgtgttttgtggtatgatgacaggtgggagtggtggaggaggcatgtgttgtgagtttgtttggttatgactgttacggctattacga

SEQ ID NO: 177 - DNA, 521 bp, Artificial Sequence
  Synthetic
tgccccatgagagaccgccaataaagagtttaggcattctgtatgttaatttttatcctcgcgaacctggtataaagtcttaatctccgcgtgcatccttgaataaaatgtgacaacgccatcgagtttgagagggagagagaaagtggatacggaacagttaaagaaaagtacatcgggatataacaaaacctccgtgtagcatacaaatgaggggacgatgaatatatttgtttgcttggtgaacaggccggggaggattgggatgaagtaatgttagtacacactgtcagagaactaacgaacttctagtgagttgctcaagaagagcaaagtgctgcgtttatagggagacctgatgaactttattaattcggtttggaggagcaatttttataatggactggagtaaccgatcagtcaatttcgtgatagaactattcttccgcaaattgagacgcaaaagctctctgattgtgatgacaagagttttgcgggtctcaataaaggaattgatgttt

SEQ ID NO: 178 - DNA, 591 bp, Artificial Sequence
  Synthetic
ccgagttaaagctacatttaaacgtcttgggtcacttaagaacccaattccttgatggtcatttgatcgaacacatgataaaacaatgaagtctttttcacgcccttgaaaagcatcgactgaagcaacttcaatttccctgtagttttcttttttaaaagtaccagtgttttgcatagagcttacaacgtaacttcgctgaccttcgtaaggtgtaataactccaatatcggcaggctgaacacctgctttgaaaaatcgggttactattttttcaacattagaagcctctgtgcgattaagatatgatgttcctgaagcagaaatctcttcatttccgagattagaccaaaacatcatcggtgtatctccaactggccaaggaaagtcaacttcatctctaagccgctcttgcatcgtcacaccattctggagagttccttcatagaacatatttgacggaaactctgataggcatggatgcatacgatactggatattgagtcgaatagggtgcatttccaacatgactagacgttcaaaaagtgactgatttaaacctgctttggcagcttttttattcataataac

SEQ ID NO: 179 - DNA, 598 bp, Artificial Sequence
  Synthetic
tgaccattcgatctgaagccattaaattaagagcactccaataattaggtagtttaagtcaagatatgtaagctccaatgatagcgagaatcaacactcttgaggtagtatgactaaagaggttatacgtgtcaactcattcaatcttataacccaaacacagcaactccctattctctaatccaatttgtagacgttaattaaaaagaacgatcaagactccgaatctttcaaattcaacaaagacagaccgaccccgatgcaatctcattattcacaacactcacgacgccagtttgccttctcccaactttcatcaattctttatcacgtacgacagcttccacaacctcggaaaatactcgtcttacattctctcgtgtcttgctgcttacttcgcaccaaccaacggctcctctaatcttcgccttggcactagcttcctcgctgctcactcttcttaaccccaagctcgctttatcacatttacaaccaacaaggtaggtcacagctccaggtattgcatttgtctctacttcatcaaaccagcggtcaagagcgagaaaactttcgcgattggaaatgtcatacatcaaaa

SEQ ID NO: 180 - DNA, 594 bp, Artificial Sequence
  Synthetic
cgcgagtaagattatatgacgaccattcttcattagaaaacgatcgacttggggcttaatattttgaacgctttgtgcattagctttaagccatgcgacatctatttcaatgtcaaagtgtccaatattgcaaacaatagcatcgttaggcataacttcaaaatgttttcctactaaaatgtcacggcatcctgtagtagttacgaagatctgagcttgacttgcggccttttccattgtggtgacttggaagccagaaactgcagcttgtaaagcatttatagggtcaacctcagtaattagtacacgtgcacccataccctgaagagctaatgcacacccttttccaacatcaccaaaaccagcaacaacggcaatttttccagcaatcataacatcggtggctcgtttaataccatcgatcaaagactcgcggcagccatagagattgtcaaacttagactttgtgacagaatcattgacgttaaccgcaggcacgagcaaagtattgttttttaacattttatataaatggtgaactccagtagtggtttcctcagatacaccaaagcaaccttttaacatttctggata

SEQ ID NO: 181 - DNA, 598 bp, Artificial Sequence
  Synthetic
gaccaaccacagcacatttcaaagacaagtacgcctaatgaccaaaagtcaaccatcttagtatatcctgtttcatctaggagaacctcaggagcaaggtattccgtggtaccacagaatgtatttgtcgtctcatttttggtcaagttagcttttgaaagaccaaaatcacataaagcgatatgtccattagcatcgagcagaatgttttcaggttttagatcgcgataaacgatgtcatgtttgtgaaggtgctggagagccaaaatgagctcagctatgtaaaattttgctcgctcttcacagaaccttccttctctttgtaaatgccaaaaaagttcgcctccagacatataatcagttaccaaatagagatcacttggagtttggaatgaaaatttaagtccaacaatgaactgcgactctgccatagctgttctgactaagatatttctttcgccaacagtatgggcgacctctttcttttgtacaataacctttttctgaaggactttcatggcataaattcttcctgtatcttttttcctgacttgataaacttgaccaaaagttccttttcctatcagtttcaagaatt

SEQ ID NO: 182 - DNA, 447 bp, Artificial Sequence
  Synthetic
ttttaggcgttacaatcttcaataaataactaacatcgataacaggtcgtataccagcagatactagtaaagaaacgaagatttacccccttcctcatacctatgtagttaaggacatcgtcccagatctcacacagttttacaaacagtataagtccatcaagccataccttcaacgtacatctccctcacccaatggtaaagaatatctacaaagtaaggaggacagaaaaaaactcgatgggttatatgagtgcattttgtgcgcatgctgttctacttcatgcccctcttactggtggaactctgaagaatacttgggcccagctgttctgatgcaaagctatagatggttagcagattctcgagatgaaaagacagctgagcgaaagagtgctctggataatagtatgagtctctatcgatgtcataccatattaaattgtt

SEQ ID NO: 183 - DNA, 527 bp, Artificial Sequence
  Synthetic
ttgagcttctgggtgttttgtaagagagtttgtgttaaatagtgtctgtatagaaattttgccatcaaaagacgcagttgcagaaagtgctggattatgaggatgaaatcgagtctgaaaggtccagtttgtagcttcaggaaattctcccaggagttctccaagctgtgggttccataagatagttctattatctttgccacatgataacagcaaattgctgtcttgttgacaccatgagattgataaaattccctgattatggccttgtaatgtacattctggtgcattggaatttcgtaaatcccaaagaagaataactggttttgtatcatcaggtgttgctgttagtagcttcgttgaattttctggatcccaagcaatagctccaacagctttacgattgttattcaaagtcaatgacgcttttttggtttttaagtcccacactgtaacaaatcctccagttccaccagtagccaaaatatgaggaactttcctattccaggcaacacattcaaggtcat

SEQ ID NO: 184 - DNA, 574 bp, Artificial Sequence
  Synthetic
ataaacctgccttagatactaaatcaggagttggcgttttatgggattctattagagttgtaaatttcaaagatactttgattggattttcttagattaacctcgacgagaatcgattttctagatttttggctaaatcatacgaattcaaattttcttagtaaattggacaatgcgcgccgtaaacatatcgggatgaaattttttaataataaaatcaattgaaaataataaatttatatcctatttaatcaccgccaacaagaagttcgttttccttacctacctagaattagtttttagatatcgttcgatgtttcgtgaatttcaaatccagatgttgccgccgatttgttcttgatgcacctctagcgtatctccatctgccatatcgagaaactcaggactatcagtttgttgaacacgactcccttcaaataagaatcgaacagaagaaagtgatttcccttgcctctcacagaacgcgtccatcaatttcttaagtggtgttgttcgtttaattttgaagaagacttcattattgttatctgtaaccttgatatttaaatgttca

SEQ ID NO: 185 - skipped

SEQ ID NO: 186 - DNA, 463 bp, Artificial Sequence
  Synthetic
gtaggagatgaccgtgacgcattaattttgttatagtaccacttgtcaaggaaagatttgggatggttagaattgacagtggatagctgactgtattctggcatatgcactaaattaggccacttttcctttgttggaactccgagtatctcaacaattctctgcatctgattttgctggaacggaaccacttttttggcttcgatcttagcttcttcacccttaaatattggtcgcaatgagagaagttcagcaaatatacagccaatagcccacatgtccacggcaggggtgtaatgtctagagcccaaaagaagttcaggggcccgataccaaatagtcacaacaaccttatcaccagtgaataatggatgaagaggtttatgaaatatacgagcaaggcctagatcgccaatcttaacttcaccagatgaggtaaccatgatatttgctggttttagat

SEQ ID NO: 187 - DNA, 456 bp, Artificial Sequence
  Synthetic
taatacttcatctggaagccatcgagtttgctttttattatctgaatttttgaggcattaaactacaatacctattaaggttcaattcaacgttacagtatgtagcagtaaatatcatttttggtataagaataaaaatattcaaatttttaccgaaaaaaatgaagcagtaagtcatatttctgggtcaagtctctgtaagtcttgcgcatcaagcttgcaattgagactccaaatgtgactggatatgtatatatatatatatatggtgttatagttgtcaaatcgaatctattctattctttgaatcagatgtagaccagatgctgtttctatgatttgactcatttctccaactttgagttcgaatgcagcatcttcgaattctttctgcatatcacctctaccaaagaaaccaaggtcaccttgttttttagcactattgcaatcagactc

SEQ ID NO: 188 - DNA, 586 bp, Artificial Sequence
  Synthetic
acctgaagcaggtcttgaggatgtacgggatgagatttgagagtcaggtttcgtaataaatagtgattcaaaagatggaaatatgtgagagccactagtattatctctagatgctgttgagaagtcttcatcttcgtcatggccatattcaagactccagtaattaggatttgactccattatactttgtgaaatctgcgcacgctgagcgagcttacgaagtcgtcgtcgttccatcatccgaaaatatttttcatcatcataactctgctctccaatttgttctctttcaatccttcgtcgctcgtataggcatatttgggctgttcctttctttcgccatggaatttctccaagttcgacatgttctaaaatcatgtagatcttcttcaactcaggatcgtcaataacttcaagcaggcctaccacattggcatgtcggacctttttcagaatagcaatttcgcgcttcgttttattctcgggtgaaaacgtaactcgacccagcctacgcttttttgaaaatcgctgaataatcttaatagccacaaaatctccagtttcaaggtttcttcccaatttaact

SEQ ID NO: 189 - DNA, 590 bp, Artificial Sequence
  Synthetic
ctcgtccattccttctccagtataccaatgtaagaaagcttttcttctaaacatagctgtgaattgatccccaacgcgcttaaagagttcttgaatggaagtggagtttcctacaaatgtagatgacatcttaagaccacgaggtggaatagagcagagtgcggtttgtacattattagggatccactcgacaaaatatgcagagttcttattttgtacattgcgcatttggtcctctacttctttcattgataccttacctcgaaatattgctgaacatgttaaatagcgcccgtttcggaaatcagacgctgccatcatatttttggggtcgtacatttgctgagtcaactcgggaacagtaactgcgcggaaagagtgggcaccgcgacttgttagaggagcaaatccaaccataaaaaaatgaagacgaggaaatggaaccatgttaactgctaactttcgaagatctgagttgagttgacctgggaaacgaagacatgttgttacacctgacatgactgcagataccaaatgattcaaatcaccatatgatgggtttgaaagctttaaagttctcatacatattt

SEQ ID NO: 190 - DNA, 573 bp, Artificial Sequence
  Synthetic
ttggttgaagaagtcggcgcataacatctaaaactgttgtttttcgtacagttttggcctgctctacgttatggccagtaaaaggcgtgtatgaagtcatgagaaaatgacagcggggagttggaataagagaagccacaatgctaataagatcgttatgcatgtagcctggatatcgaagagttgttgtgctagccgacattactgtagagaccaattggttagtctgttgaaatgaaggttcctgaacatgtaggcgatcagctgcaatacgagataatgcaccgttatccaaaaccacaaccgagtccgcattttgagtcaggcgccgcatggagagtagactgttatatggatgaacaacaacatcgcccgaattagtcgtatctgggaatacagagtaagtctggatgatctttttaggaaaacggtcattcagtcgttccaggaggaaagaaccgaggccggatcctgttcctccagcgatcgaatgtaaaatcatgaagccctcgagtgaatcactaccatcagcctcacgatctatcatctccataatatcttcgtgaaccagtt

SEQ ID NO: 191 - DNA, 568 bp, Artificial Sequence
  Synthetic
cagatactgcccaaactaccttcataattttccgagctacacaccagaacctcgagtattgacattacggaatcatctcaccatttaaaagttgcggtttaacttaagctgtagccgcaacagtttcagctgtcccagctagtccttctgattgaagtttatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgaggttcgttgcgggcctgaagctttttaaccatgaattttggaataggacgcagagcaattttggcagatactggttcgtaatcggcaaatagttcctttaacttttcctcggataagtcataaggaagattggcaaccataacttttgtcttagatggaac

SEQ ID NO: 192 - DNA, 598 bp, Artificial Sequence
  Synthetic
aaatgtgtaccaccttcttgatgtaattctgaacgcagccaaatctcccaagtcagatccatcgtcagcccgtcctccaaagacatacatcacatcgtcaacaattgctgcagcatgaccttctcttggaaccggtatatatcctatgcagtccaaaagagtccaggagttcggtatcggatcataacaccaaacatcgttataccattgaagaccatttgttccgccaaacaagtaaagcttttcattatatgtcacaactgagtgatttgttctagctgatggtatttgtcctactgggggtccaccatcctcactatttttaatgagaatttcccacctgttcgtagggacttgcaaaagattcaaatcaaaagccacaaggtcattcataaaataaccctctacttgccccccgaatacgtagattttagaccctagtatattgagagaatgaccataacgccccgcgggccgtggcccggcaggtatagctctggaccattgtcgggtagaggtattaagtaagtaaagagtttcatctaatacgtcagaatcgtccattttagtatccccaccatatacaataaaagcattt

SEQ ID NO: 193 - DNA, 598 bp, Artificial Sequence
  Synthetic
gtagcgaggatggacactggagaacggttcgaagtatacttgacaaattacgaaaagctgggctatatctcgatattgataaatgtgagtttttatgtaaagaagtcaaatatttggggtttattgtgaaagctggtaaaagtgtggccgttgatcaatcgaaggtgaaggccattctggagtgggaagcgccaactacggttagaggggtaagatcatttctcggattcgccaacttctatcggtgctttattaagggattttccgacattacatcacccctagttgccctgacgaaaaaaaaggtggaatggcgatgggggcgtgacgaaaatgatgcgtttgaaaggctcaaagaaatattctcatcacagcctgttttagcacagtgggatccagagaaggaaacaattttggaagctgatagttctggctttgcaattggtggttgtctctcacaggtggatgaacacggccaaataagacctgtggcttatttctcgaagaagttaaatagtgccgaagctaattacccaatccatgacaaagaattacacgcaatagtcacgtgcttaaaagaatggaaaccagagctaat

SEQ ID NO: 194 - DNA, 580 bp, Artificial Sequence
  Synthetic
ctgaccggggcgctattacgattaaatgagctgttttccccagcgctataagcatccagggagaataaggttacaaaatataatccgaaaaaagataaaaaagtatttatcaattgtttcaaatcgaatggcttagacaactgtgtactcggactcttagtactccctagagttcgtccttctgaggtatatgatagaccttctaggcctgcaagtctgatgacagactcgatagcagttcttaaagtagactgatcagcgccacggatcgtattggcaatagagccagatcgaaagataatgaagctgggaagtgctctaactccataacgctgagaaatatcctggtgattgtctacattgaccttgacaaaggtgatcctgttcggtttcgagtatttggaagcaagactttcgaaggtgggagcaatagcattacatgggccgcaccagtcggcataaactaacccagccattagtagatttagttaatcggtgacgactacttttgaagagttcaaaattttgtcaaactgagatgaggatctgatacggatagacatgctttctttctgttcaa

SEQ ID NO: 195 - DNA, 594 bp, Artificial Sequence
  Synthetic
aaagttatcgccgaagtcgcagaatatatatccaaataatccaaaggtttcagttattactacatatattcccttctcatgtagatactgggagattatgagctggtctttcagtggaatatctgtcaatattacagcttgatatgaatcaaactgggagagatcagaaactaagcttgtggagctgtgaatcttaacaggggtgtaagcatttagttccgaaactcgttgagctgagacaatatctctaggttttcctatatcttctgggttaagaaagaattgagatgataggtcagcgatagttgcgggagcgggatcgtataatgttagacttttaactccagccagagctatattcttagctatttcgataccaagacctttcaagccaataataagaatattcgatgcactcattcgtttcatagcctcgtgtccaagaacgtagagttgcctactgtataaagactcatcgataacattattattttcttgtgactcatcaacttccatcttcatcttgtcttcaattttactgacttcactcatcttgaatacttcctgtaaatccaatttacatcaactgaatta

SEQ ID NO: 196 - DNA, 580 bp, Artificial Sequence
  Synthetic
ttgactctagttttaaatacacataaatgtttgctcaaactatctagagattttgcgtcttgtaaaaaaatactatatatgaaatattattgtgtactattgatgtatgaactcgatgtgaggtttaaaatcttattgctgccatagataatcaaaaaattatattaatcctatccttttggaacgattcctaatagcagatgtgtgttcgtctctgtcctttgaatgactcatttcagtccaaatcttcgttgctaattcatccactcatttcatagcatatttttttgtcgctttaaccgcctcttcattaaattcattcctgttattcctgtatctatctgctaatgccgtttctaccgcatcatcaagtaccggctcggtcagcatttgctgcgttgccatcaaaatattgatgattcgagatgatggtttccaggcatctggtttgagagcaccaatacacatactaccctgctcatcaaaagtcacatttggatggtagatacgagttttgaacgatagttttggtggcttaaaaggatagtctgaggggagcgttaaaagaagttcaaagtta

SEQ ID NO: 197 - DNA, 527 bp, Artificial Sequence
  Synthetic
ttccaaaaaaaaaactcatcaggtttttagaacacaatcaaacgtttggcccttaatagtaccgccagccatactatttctaacatttctcttgaatatctcacgatgattccgaagatcttcggcggcttctttattcaacggatccgaagaatttggctctaaaaagagaaaaataattaaagaattccagtagcgaactagaccagagtagagcaggaaggagtattcgatgatacctaaaaaaagacacacacgttataaaatggctctaagaatggtattgaggctaatgtatatttttttctttgaaaaaacaaaaaacaaacaaacaaaaaaattatggataataagtaatcctaccactacactctgtagatttaggaccggtttccagtcctcacgcaagatattgagacacacgtttccatcaagatcgatatttggatgataaatcttttctatacattttacttttggcgcttcatgagggaagttttgagagatagaaaaagtgaattgaaaac

SEQ ID NO: 198 - DNA, 560 bp, Artificial Sequence
  Synthetic
tcgtcatcctcgtcttgttcaaaatcatagttatcatcgtctgagctctcgctggtaccgaactcatcctgatcatcactctcgttccagaaatcatcgtcatcattaatttgcggaggaggcgcctcaattaatgtttttggcatcacaaaaccctccggtatatctctcatagaaattcttactgtctccaaagcccgctgtttgtaagcctccaggttatcccgatacataacgctggcatcaacatttgcaggggaggtaatctcagggtcatctagtaagagaagaatagagcggagaacactttcaacactctgaattgatgaccagcgctcacaagcaagctctccagattgttcatcatctccagcagcgtgtagtattgagatgcaaaccctgccatcaggatatatatttggatggtaaataggttgcaagaatttgaaggtcggaggagcataaggatatttatcagtaaaacccatttcagccttaaaataagccccatcgaaagcactttctgggttgactactattagagcgattaaccacttgaa

SEQ ID NO: 199 - DNA, 586 bp, Artificial Sequence
  Synthetic
aaaatctaggcaaatccttgaaaaactcagagctttttttttcaataaaattcaagtcaaaaaaattcagatcttttcgattttcaggaataatcaatttatttctgcgatttatcgcttgatttaaaaatatactaggcacccaaaaatcttgacttctcacattttctgtcccaaggacaatagtttgctgaattaattgtagatctgtatatatctgttgactcattttctgaagccagaattcatctttcggtataacaacgccattaatgataactgggggaacaaggtcatctgcacaaatcctgtctacccatttttgggacgattgaattcgactctcgagctcatctgatttcaaaacttcgtcgaaaattattcgggttttattagtcttaatttttgctttctgggtgatttggtcgaatacatccttactgtttaagctaagctttgattcattttgtgaccgtaaatatgctattgcagtttgtaatccataaatttcaataaggtgataaattacttttgcttcgattgcagcatttgagtttctgatgacgggaatgagaccaattcggat

SEQ ID NO: 200 - DNA, 595 bp, Artificial Sequence
  Synthetic
cttgccatctcttccaacctttctcttaccatcaaactttgttccttttactgtgatcctctcgacaagttttccgctcaatgtatcccagacaaccacttcaccatcttgtccttcaatattctcgtttccagaaagtatccatctctctcttccaccaaaacagttccatattcgaaattctttgttttcccagcaatctgcacgataactccttagtaatttaccattctcggtatccattagtctaagctgactatccagtccacctacaagtagaccttttttatctattgtcttccttagacatgtcacaggagcaccaataacatcgacaacaatttgtcccattctaatgtcgtatttcctaacttttccatcgacactactggtccatatctcgctatcactcgctaatacgcagctcacactatcaccagcctctgttagaaccataactggcttagcactcgagctcttcacatcccagatacgagcactggcatcaaaacctccactaataagaagactggctccatccccagcaaaagtaacggtattgatgcgtgccgaatgaccattgttgccactaaat

SEQ ID NO: 201 - DNA, 590 bp, Artificial Sequence
  Synthetic
tttcagtacgtgtgcttgccaatagatcgtttttggttggtcaatagaaaatcaccttgatggactgaattttgagattcggtaaagattcgccgtagcaggacagcattgattggcaggaacccaatttttggacgctcagggactggaatcccgatggttaccgggcttctctcgcattgcctcttcgtgaagcaagctgagaagttgggagaaaaaaaaaagggagattctagctcttcgggactgtaattttcattcgttgacgtttccttggtctacgttcccaatcaactgactcatattgaaaaatagtttgaggcacagaaagaattactagacacaatggctccaattgcgacagctgacttgcgttcttcaagtgatccaaatgtcaaagaatcaagtgacgagcagtcaaaatcaaacatcagacaattacccgtgacacttttatctggatttctgggaagtggaaagacaactcttctcgagcatatcttgcgctctaatgaacatggccttcgaattgccgtgattgtgaatgacatgtcaagtcttaacattgatgcttctctgatccaacaaca

SEQ ID NO: 202 - DNA, 556 bp, Artificial Sequence
  Synthetic
ttctcttagggacggttggcatcattattaattttgcagaaccaattccatctcgatcttttccgatttattctcaaaatggagatattgtttatcctcaatttgcatatcctcttcgcaagaatatcattccaatttgggtagcaattttgttggcttcacttattcctttgctcatcattttccttacacaatttcgtattcgctcgttttgggatgcaaacaacgcgattacagggctattatactcccttattatcgccggagtgtttcaagtcttcttaaagtggttaattggagggctgagacctcattttctaaccgtctgtgagccaataattccaacacgtgctccaataaaggctagatatgggcctagaataataatgtacgacagaaatgtctgcactggcgacaaaaggcagatcaataattctcttgaatcattcccttcaagccaatcgactgtagcattttctggtttcgtttatttggctatatacctgaatgcaaaacttaaaatttggtctaattaccattctgccatgtggaagat

SEQ ID NO: 203 - DNA, 545 bp, Artificial Sequence
  Synthetic
tccgcattgatggaggtttcagctatagaattgcattctaattctagatctgcaagttgctttgaaattttcacttgttccccaagtaaatgtttacgccaaacgtctgcatccaaaacagcttgaagcgcaggagtatcatctcctcttatctcctgttcaacgtgaagtattgaaatatgagtaggaatagctagttctcttcgggcaagtgcacgtaacaaagtagattttccaataccattctgaccgacgagaccataccttcgaccgtacgctaagcttaaattggtatctgtaagtattcttaagccgccaatagatacatcaattccatcaagttttatatctttgcacttttgctggccttttaacgatccaagttgaaggggattgacggccatgaaaaattcttcgtatgactgcgtattatctgcttgattaagaagccgtgaagcttcgtactgaactgttttaaaaacctttttgctctgtttagcggcaatttttcgttccgctttttctagttttttgcgatcaacttt

SEQ ID NO: 204 - DNA, 556 bp, Artificial Sequence
  Synthetic
cggacttcttggtcaggcgcaaaagaagttgaaaatacctttccaacttccaaatctctggacactatcattgaggggcccgatggctgaatattccacagttttacgagtttatcagaagaccctgtggccataaacccgggaatgataggattaatatcaaaagcacaaactgatttgtcatgtgcttgcaataaccaaactggcttactagaactgggagtagatggtgccattcgtatatcgtgataatggaccataccaccttctgtcgttacgtaaaagaaatttgggttgtgtgcatcccatttgacagcttctacatcactttctacaccccaaatcggcactttggattctggtgctctcatgtcggccgctacgacactccgatcataacttccactaagtaagacagtggagtcaacaggatgccattgtattgagcaaactttatctgaatgattactatatgatttagcacatttattagtattaaggtcccatagtttgacagtcttgtcggcggaagaagaggcaagtaaattttggtgtt

SEQ ID NO: 205 - DNA, 477 bp, Artificial Sequence
  Synthetic
tccccgaatttttggcatccttaaccgaagacaccaaattatgatcggcttcgcctcgaaacagttgcattatttcatgcatgcccaacttgctaataccattgtttttaccgccttcgatcgtttgttgagctaactcacgctttttttcttgcagcgtgagaatacgttcctcaacactattagcaatggtaattttataaacgattacatcagttttttgagtaagacgatgtacacggtcaattgcttgttcctctatgaatggattccagaaaggttcgaggataacaacgcgggtagcagctgttagatttaatccgagggatccgcattttaaactgcataatagtacacggcaagaattatcatttcgtaagctgttgagactagcttcacgcaaatcatttctcatttttccatcatatcgagtgaatttgaagtcattctttagcaaaaatgactcaatgaggtcaa

SEQ ID NO: 206 - DNA, 595 bp, Artificial Sequence
  Synthetic
tctcttcgcgaccgatatccatttcctgagggtaacagagaatgatcttcagcactgtctgggttgtatctgccagttccctcaacatctgggtcgtccctcaataagctatgtaagtcctcttcagcgtagtctaaattccttggggccccatttcttcttcctaaccctctgaatccgctcatgcgtagatttctcaacggaatattgctttcagttctccagtcatgcgctttcggtttgatcccttgttcaagctcctggatatctaaatccagatcggagtccgaatcagcttgaggtggaatttgatcgccctgatgataatatgagcccgaagacatgcctcattgtattttatcgtttgatctctataatctcctaggtgatgttataaagcttgaccgcataaaatcggttaatcatttaagcaaatgcagttgcggtgtgtcatatctttcacggcagcatctagtatgtctagtatggctgctactgtattttaaataaaccaaaacatgttcaacacatttcataaggtataagaaggattgtgaatataatttactggtaaattttaaatcatagttgaaaa

SEQ ID NO: 207 - DNA, 539 bp, Artificial Sequence
  Synthetic
aggatcttcttttgctctgcatttcaactcgaataacctcaattggttgattccacgcactcaaccctcccccaagggcactagcgagaattcgttcccaagcacttaatggaccgccattttcttttcctgaaacctttcggattccctgttctgccaaacgacttaatccaaatctggatccccaattcgtcatttgtcgaatggcaacagcattcacacctttattaatacctctgatcccatctttacggtatatatccataaatgttgagaaagttcctgggggctttacaccagtggatgctaatttggatttcgtaatctccacagttttcatgcatgtacaaaagcccatagtggcatatgcttgagccatacccccgacaacgcctcctgtgatgccggctgtgaagatgccggctccaaaacttcgagcatagaattctgcttctgaagcgacaaatagaagaactgcaccttttgatgaagcttcaatccaagcccatgggatcaagccctgataaaaacccaaaaca

SEQ ID NO: 208 - DNA, 598 bp, Artificial Sequence
  Synthetic
ttctctaacgtcggaagtagtagttttgtgagtagaaaatgccctatatggtttgtaccgaactgaatctcatatccttgctttgattttcccgcgggtgtcaccataattcctgcattcaaaaacaagagatctaatctcttttctctgttaagaaattcccgtgcacacgatttcacagattcgaggtctgctaagtcgcagggtaggtatgagactttagctgatggaactgcacttttgatacttgccagggccttatcagcagtagtctgattacgacctgagatgtagatatgcgcaggattttttctagctagagcaagagccgtctggtatccaatacctctagtccctcctgtaatgaaaattactttctctgactgatctgggatatccttctcttgcgagaaagagaccccaccgaataacagtccgtagagcattctcgttctcttactgtaaatcaattaaatctatttcctgtgatgcgtgattcagtgcgaaaggtgagaaaaaatcaagagcagctagcggcttaaatactcctcttgcaagcagatcatgcatgccaataagaatattcaaggattcatgt

SEQ ID NO: 209 - DNA, 596 bp, Artificial Sequence
  Synthetic
ctggtgcccttaacttgatggtaagattattcggcagagtttttaccatttgaatatttggtattgatttatatccttgagcctcatttatttgctggatagcccaagccttaaacgcagatctttcttttctaggcgtattctcaatttcatcgcaatcatcagaactttcattctcatcacggctactttctttactgctatctgactcgtaatcagataaatttggtccaattttatctccaacgtcttctgaggaatttgtcatgtttcctatggtatcacgctggattgacatacttgaatctgagtttataccttcccattctgattcatcatcggtgacaggcttgcgaatatcaagagaaaatttagatacaatgccgcctcgtcgttttcttttccccagaataggaattccctccttacttatttcgagtggctttttttaatccagctcccacagttatatctgtttgcttctgagtagtaagtactgaagctttagaggtctcatcgatattatcgtcacatggagatattctcagatcatcattggttacagtactctcatcggaattgaattgattttcgtt

SEQ ID NO: 210 - DNA, 481 bp, Artificial Sequence
  Synthetic
cgcgttcataaaatatatcttcataatcagcgtatttaggtgaaagtgtagtagccaatgtccacatggcatagcatagacaaattggaggacgggtctgaattggacgttccaaagacatgtaaaaccgggcttgatgtatgatgggcattgaagggtgatagagagtgaagtagatatgatataattctttaatcatataatcaggcggtaatggttcttgaagacctaagcttagtagctctttattgatatttgatgtagtttctttaggcatctgggagaagcctgaaataggtggcgacgtttcaatggatgtaagaagaggcctaccatcaattgccaaattcaaatctatacccatattccaatttctttcgagccggggagctgcagcatcgggacttatgatatcgcattttccttccgagttgagtcgagtctccaattgagctagcctagcttcaatttctttttcttt

SEQ ID NO: 211 - DNA, 598 bp, Artificial Sequence
  Synthetic
tacccatccctggcttaagtattgatttatacattctaaaagagagttcgacgcatattatgatctacatacggaagtttggtaggatgacgaaaactcctaacttttaaattgaaaattcaccaatctgacaacatatctatcttattattgttgccctaatcactgcctttaatgaaggaataaaaaattaaaagatgcccgtcactgactaacgctttttttttaattagccaaattatcagttaactgcaaaccagctacagcgagacggtttaagctcccatatttacaaaaactgacttgatttgagtgtaaccagctagaccagcttctcctagctcccgtccaattccactctgttttacaccaccaaatgggaccttaaaacttgaatcattacttgaattaatccataccatgcctgattcaatttttcgcgctacccgatgagccctcgtaatatccttggtaaatactgcactaccaaggccataggtagtatcatttgctatctttagggcttcttcttctgttttaaagctatttatgacaacaaaagggccgaagacttcttcacgaaatattttcatagatg

SEQ ID NO: 212 - DNA, 554 bp, Artificial Sequence
  Synthetic
taacacccgcagttgccatcagaaagaagggagtatctttaacttgattctcaggtacaatactcaatgcatgatctagtaagctttgaagatgttcaggaccaatatctgttatgcgatcggcaaaggaagagacgccgggtttgattttttttgaatatccaggtttagtgtgtaactgaggtagttggttcaattgaatctcattttttgcatcgtaacgagctcgagatgtattgagccaccggtagacgtggactcgagtccctgacgagcccgcgtctaagataaccccccatcgccatttacccataagtagcctatcgttacggtttggcgatgccggtctaggatatgtgcttcaatatcaaaaataatccgtgaagcgttacaaaaacatgagtcaattatacggaatttgaaacgagtgtgaaaggaagtcggcagactcaaaaataaaaaagaaagataataattcgaatttgaatgagaatgagtagtggtcggataagatgtttaatgctaagtgctaagataactgactaagacttgat

SEQ ID NO: 213 - DNA, 456 bp, Artificial Sequence
  Synthetic
tacggatcgatagacgggtgagtgaaagatgaagtgcaggatttttctctataagtttcttacgttgtagcgccgaagcttctctaagtttaatctctgatggagataaaacgttatatataggcgtaccaacagcaattgtcccctctttaagtagatataactttcgcttatctttgtctcggtcagtgcggaagtttgtcccagcttctgtaagttttacagctttttctcgattaactgctcttgacacttgaagtacgcgaccttctattgtgtataagccattcttatcagcagtttcatcctctaaaatagagtttttagctttaacagcgtttgcaccacttttgaaggtacgaggtgcaccatggtaacaagagtccgcatcttcttgtctatagaagcaaacaaagccagtgcctttaggtcgaccagtattattgtctatgacca

SEQ ID NO: 214 - DNA, 553 bp, Artificial Sequence
  Synthetic
gaccattgtggtctttcgacaaaatgatttcaaacagccctcgtgtgcacatttgtatggtctttttcctgtatgaatacgacgatgacgagccagactagatgaatcagagaatcgtttcccacaaccaagatgctggcattgatgtggcttttcgccagtgtgtgttcgaatgtgcacagttaaggcacttctttgaatgaaactttttccacatccaggctgcatgcatgaatatggccgttcgttggtatgtattcgatagtggcgttgaaggtcagacttcctgttgaaactcttgtgacatgtctgccaatcacactgaaatggtctcgcattaggttcgttttcaacgagctccattacatccatagtgaaccgacaagtagtgtcgaatgtatgcaatgtcggagaagttaagggttggacaagaggtaccgcagcaaaagctgcaggtgtggtgattaggtggggatgggtgtcgaatatataagattgcgattctctatttaaagaaaaaagaaatataagcaaaataaaatatttcttttga

SEQ ID NO: 215 - RNA, 497 nt, Artificial Sequence
  Synthetic
ucuuaccaugaagcguuccauuccuauguaacaauaauacaaaaugaaguagaggcauauauaaacaauugcguuagcuuucagggugagaguggcacaguaaacaucucaaaaguuauggcggaaaucacuauauauacugcuucacaugccuuacaaggagaagagguccgugagaauuuugacucaucuuuugccgcucuuuaucaugaucuugauaugggauuuacaccgaucaacuuuacauuuuacugggcaccucuaccuuggaaucgugcucgugaucaugcccaaagaacuguugcuaggacuuauaugaauauaauccaagcucguagagaagagaaaagaagcggugagaauaagcaugauauaaugugggaguugaugcguuccacuuauaaagacgggacuccgguaccugaucgagagauagcgcauaugaugauagcccuucugauggcuggacaacacucuucgucauccacgagcucaug

SEQ ID NO: 216 - RNA, 449 nt, Artificial Sequence
  Synthetic
cucaccuuggcaucuacgaagccgacaggaaggugguggcuacuauggccaaccaucgaauggugauggaaguguguauccaccuucaucugguacagguggcuuucuaucgccaacugcuacgagcgguuauccgucugcaacuggaacuggcggcuauucaucuccaucgggcaccgguggcuacccgucugcaacaguugaaaaagacaauauuucgaaguucccgagagcuuucguauccggcaaugacugcaucacgucgaauuucuacgauccaagacgaaaauaguuuguuuuuuugcuguuggcguggagucuagcuguuguguacccgaacccuauucggaucaucaaauaggauuguaaguugguucaucauuuuaugaacagauucaaauuguauuaccccauucuuaaucaauaccaugcaggugugacugacaguc

SEQ ID NO: 217 - RNA, 460 nt, Artificial Sequence
  Synthetic
uuggaagaaccgccagaaaacccaaucagauaccgaucucuacucggaucaucauuucacuucgcaacaugcaauuaacgguuauguaccuucuauaggcuuugaauccgaugguuaugggauuaguaagagaucuaaucguaaaacuguucauggauauuacugugggagcucaaaacaugagcagcauuuuuaugagcaggacuauauuaaaauauauacaugucaaacauaaugcaaacuuaauuccauauaguuaacugaaauggucauuuuuucacagcuuuaacucaauuccuuuugaagagugauaacuuuuacuugcaauuccuaauuaaaauaagagcacaagccuuaauuuuuggaucuaaaauaucaaugccaaccccuugugcacuguugguagugaaaaucuucguuauuugugacaacauccacaaucucgcacugcguauugaua

SEQ ID NO: 218 - RNA, 481 nt, Artificial Sequence
  Synthetic
aguagcagcggacaucgccgacggcccuacacugucagggcuaccugggguugcagauuucgacuugucuucagcguccuccccaagucucgagaaaagacuuuguuuuagacgaggaugcaauaaaaaaucuaaacacgcaucaggcuuccaauguaagaagaaacauuucagucuggcggcgguagaaaaagcaaaagccguagccugcgcaaagaucaaagaaaacaagcagcgcaaugccuuuccugcucuuuacaccgcaaccgauuucgaaacucccgggccuuaucuagaauggccaaucaagcgcaauggaagauuuuggaauaauuugagaagaggccguuaccgcaucauccuaaccgaaaacugcaaaguugucggugcugugauccggaaaagcaaugguucauaccgcacaugcaagaaacugagcgaaaaagaugaagaugaaguugaugaugaugaugaaaaagaa

SEQ ID NO: 219 - RNA, 475 nt, Artificial Sequence
  Synthetic
augcguuucaucauaggagcugucgucucuucacucauuuugucgccaauuucagugcuuucuauggcggcuaguaaugacucuaccgaagcugcagcgcauaucauaaaugauucuauacuagaagauguuucgaacguugcagauuucgacuggucuucaacgucauaucaaggccuagagaaaagauuuuguuucagacgaggaugcaaggaagaaaagcucaagaggacaucagguuuccaaugcaaaaagaaguacaucagcucggagaaaauugagagagcaaaagccgcuggcuguccggaaaucaaaaaaaauaagcagcgauccgcuuuuccuucucucuacacugcauccgacuuugcuguuccagguccuuaccuagaauggccgaucagccgcaauggaagguuuuggaacaaauugaguaagggcaaguaccguaucaucaugaccaaaagcugcaaggugg

SEQ ID NO: 220 - RNA, 490 nt, Artificial Sequence
  Synthetic
auguucaaaaaauuuauuuuccucucaagccaggccuuaaugguacuuucgaauccucuuuauauuggugauaaucaucuuccgagcgaccaaaauaauccguucuuaauauccuaugauuggaaagcuggcuuuacaagcgaauucgaacuucaugauuccugcaaugcaacacagaaaaaacagcugcaagacggccucucugacgcugugacacuugcuaggcaugcuaaagaacauauucuugugaagggaacugaaucacccauauauaagaaauauuucggucaagguccuacaggaucgguccugggaugguaugacaaaauugcuucuucugaccgaaaagacauccuuuuccguugugaugaccccgauaagaauugccaaacucaaccucaaugggcuggacaucaccgcggaaaaaaugcgucauuagagacagugaucugcgagcuuucauuucucacucggcuuccacuugaagcuc

SEQ ID NO: 221 - RNA, 226 nt, Artificial Sequence
  Synthetic
acgauuaucgccaauuggggugauacuguuguaguacauguuacuaauucauuaaugaauaauggaacgagcauucauuuucauggacuccggcaauucgaaacaaaccaaauggaugguccaacaucaauaacacagugucccauagcucccggugauaguuuuacauauagauggguugccucucaguacggaaguucaugguaccaugcucauuucgccguac

SEQ ID NO: 222 - RNA, 590 nt, Artificial Sequence
  Synthetic
cugaauuguuuugagacuguuuauuacgaaacccauuacuuuugucuuugauauggaaucuccgauugacaaacaauguuucgucagguuuugguucauagcuaguggucauuccaauggcaccucuaauguuauuaauaacaguauugagugauugcucaggcauuaaacaagcugggcgacauucggguauauuugaaacagauuguaaaauuuugucacgaaggguuguuucgucuugaaaauuuggucgcaagcauaacuggagauuacgaaguuguuuuacuaauauuucaaauacaucaagcaauggcuuuucagaauguugacuagaaagaaguugcaagguaauuuuguuccauucauucugugcauuucucuguuuuugugguccuucaaauuggccaagcauuaauugagagauuucaucgaucuguauugcauugcuacagcgaugaugguagaagucuaaugcuucuuuguuaaacauuaagaacauagaagacaggaugucuuuuucauuuucgaugcucgcuaauucgcauuuuuucaaaaagauguuuaacuugaaguuauagcuaucaucuuuu

SEQ ID NO: 223 - RNA, 577 nt, Artificial Sequence
  Synthetic
uuccggcgugacuuugagacauuaguuaaugcuacaagagaucauuuugaggggccugaaaucagacguagaagaacugcuagaugggagucacccacuuuacaaaagauaaucgaugaaaaccaaggaaaagaaaaguccauggacgauuguuuuacacuauuauugaaugaacuaagauaccuucaacuuagucuagauaaagaguuccgaacagaaaaaguccuucauacaaaacuaaucaacuccugccgcaauauaucugcaugucaacuagcauguuucaaaccuagcaauacauugacaggccucauuagcgaccuucaaucgucaauugcuauuagcgaugagaauaucaaagaucaaucaucacaauucuuuacagauagaaaauaccacauuaacucucaaaguaucaaucaaaacaaacacaagucuaauuaccagucuacaucaaaacgaagauguuaugugugcgaaaaaccaaauugccauucaaaauaccacucaaaaucagagcaagacgaggcucgaaagaaauucaaaagacguuuugucaaacguuucgauaacauga

SEQ ID NO: 224 - RNA, 597 nt, Artificial Sequence
  Synthetic
caauacuuauagacauaauguauauugauaauaaucuaguguugcauaucauugaugaagcaacuaauuuucaggcggcuagguggcucaauaauaucucugccaaacauacaugggaugccauacgugcuuguuggauugauacuuacguugggcccccagacugcauaauaacagaugcugguaaaaacuucguuagcaaggaauuuaaucaaaaugcaucaucaauggaaauuucggugaaaaacguuccuguugaagcgcauuggucaauaggaaaaauagagcgcuaucacucuugcauucgucgagcuuauaaaauuauaucagaagaacuagcuggaaccggaaucggcaaagaguuuaugcuccagauggcgguaaaagccauaaacgacacagccggaccuaauggcuuagucccaacucuuuuaguuuuuggagcuuauccaagaaugucaaauuuagacccuccuaugccauccauaauucaacgggcugcugcaaucaaaaaggcgaugcuagagauaaguaaauuacgcgcaaagcuaaccgugaauagugcucuaaaccaucgaaacggaccgaauacgaaua

SEQ ID NO: 225 - RNA, 565 nt, Artificial Sequence
  Synthetic
acaauccccuuugauccagcauauaugaguaauuucacgucucucauaugauuggcggaggcacaucaaaucuaucauuaaucuuuuuucucuggugguuccgagcuucaccaagcauucauauagugauuuagagucuguacaaacaaugagagguauucgcauacuaaauauuuucucaagugucgauuuuaugguugcuccagagucaaaaccgugcaccauugcauaaaguucagcagcgaggacgcuucuaguuauucuuuugcauuuaauugaggaccaauggagaauauuugcucgauucuccucgucugcuaguacaauuacaaaaccaauuugagaugagaagucuuuguuauuugcgaaggaugaaucugcaaaaacuauuacucuuaaugaguuuuuauugaguuuaacgaauuucaauccucuagaagcguucucaauuugccaguuaauucuuuuauuaaguaauuugauaucugcuucguuuggauugacauuuugggcagcagaggaaagaucgaaggaagcuucaggcugacauaagcuugcaauauau

SEQ ID NO: 226 - skipped

SEQ ID NO: 227 - RNA, 484 nt, Artificial Sequence
  Synthetic
cuagagcagccacguguagcaugaaacccaugacaacguuugcauuguuguauugguuggcaugguuuguacaguauagcgacuccugauucgucgaauagucggaauccgggucauggagcuuguucucgggaaaaaugugccagccaagagcgauguggagcaccagaacgagucuuaccauguacccuaaccaucuuaggcgcaaaguuagugacuuugauaauuucggcuacaagguuaguaucgucgacugucacacuuccacuagaaguuugacgggcaacgggaacaguugcaauacgauauguaauaagaucagacgccgguucuagcuuggcacccugaaaagauauucuaucacugucauuuaguagcuuuugccuuaucuccuuuucuuugauaguaagugcgaagccaguggggguucgagcgaugagcgucacaucagaugguacacaauuuagauuuuugcacaauauuu

SEQ ID NO: 228 - RNA, 588 nt, Artificial Sequence
  Synthetic
gcuuuucaaugucgaccugcaaacuaccuuuggcaacaacuugauucaaaauuauauucuggaagcuguuugagcaaggagaguauagccgauauuauauaugcucaugcaucuauaaguuguuuaauugacuggaucuuugggauauuaccgauuuuaauucucuggaaacucgacaugaaguucaagaccaagcucucuauaaugaucguucuuucauuaaguauaguagccucuauagcuacuguuauacguauuauuuaccuccauauucuuaagaaugugucacaauccgguugggaugguuuuggauuaauaaaauggucuuuacuagaaccagccauugccuugacagcugcaaauauugcaacucucaggccacuuacgcaaaaguuauuuucaaaaaaacgacgaccaucuaaaucacaaccaccuaagcuuucucucaaugcuauucggggcuuaagucggaagucuucaguauguuguucaagugaauuugcagauauguuagggcuagcaguaucaccuggcgugaaaacucgagucuaugcugauagaagacuugauaacacuauccaaaaaaga

SEQ ID NO: 229 - RNA, 403 nt, Artificial Sequence
  Synthetic
caccaacugggugucaguacuaauaccaacaguuccagcuguuuuacauaaagaacaaggaguaguugaagugagcaacagcaugcuugcugaugagguggaacgugucugcucugugcggccagcucacauaaagcuuuauggaagaaauaaaccugaggcaccguaucgaacauggauggcuuucuucccgaaagcuccacgcggcacuuuuaaaguguucgacgaaucuggaauugcgagcgaggucuuuuaaaaagcagcaaccucucgaauuuuguaaaagaugcaaugggcaccacucuauuaaaaauugcucaagggcuccuucgugcggaaauuguggcucgaccaaucauaccgaggauuuauguauggccgcaacuaaguguagaaauugugg

SEQ ID NO: 230 - RNA, 383 nt, Artificial Sequence
  Synthetic
aaagguaguggcucugggucuggaaaagggaaaaauguagaaaagaauguugcuguugcaaccccuaaauuaccaaaaccuccccaaaccucacugaacacauggguuacuguggcucgaaauggucagaagaaggcccgaguucuucaaaauaauaauauacacaccaccccgaugaguaaaauaagaccacgaguaucaauuguggagagagccucagcugcuccgacagauaauaggcuguuucuccgucucccccaagaacaugaauggcgaaagcuuucuccugcugaaauacguaagguaauuuuaaagaaacuuucaaucucacccguauugguugggaauacgugagguaauuguacauugguugggaaaauuaa

SEQ ID NO: 231 - RNA, 392 nt, Artificial Sequence
  Synthetic
cacaaccuugggucuguccuuaauuuuuccaccaaauaaucaauccuacgaccauugcgugggacaauaauucaauaaggaaaauuuaaauaaaaaaaaauuuaaaaaaaaagaaaaagaaaaaauuuaauuaaaauccauaauaaauacucuguuaauauuuacaagggaaucuuaauuauucaaccaaccaauuaucucggaaaaggauaaaggaguugguuuacaucuaacgauuagaaagccuuugaaccuaguaugcccaauucucuucauauggauacccaguuucacucaaacaauaugaauagcaguacagcgaauuauaguucauugccuagcauuucgccucaucaacugcagcagcaaaaucaaaugccgacucauauucu

SEQ ID NO: 232 - RNA, 371 nt, Artificial Sequence
  Synthetic
acgcgcggcuaaugauaugcacaaugcacggugauuaguagcauagauaguacauuagcgacuuuuacaaaagaaguagagauagaagaggcuguagcuuucaaagcguaccucaaacuugcaauagcaaacuuugcagcaguagauucguccccuccuccaccucgugucccauuacauacaagaccgaauaaagguaacggaaaugauagcaguaaagggaaaaguaaagagaaaaacuugucaaagauagcagucgcaauaccucguauugcuuguaaucgaauuaucaugggccacaguaaucaaaauccaaaucuggguacgaucaaagaaauagaauuaccaaaaauuauuaaaaauaugauaua

SEQ ID NO: 233 - RNA, 521 nt, Artificial Sequence
  Synthetic
aaaccgaaaucuacgacagguaaagcaucacgcaauauaacggcgaaagcccaccugcuaucaccuacucucaacguccuacgaaaagauguuguuuucgagaaagcgcucagugacaugcauggcucuuccgauaaauaccuagauaaagacucuagcauggaaauuaauauaggugaugauaucagcgaggggucgaaugcggaucccuuugcagaagaacuccccacgccaucaauagcgccagauacugcgguagcuaccacacuuaacuuagcacauggacaggacgugaaagauaaucacaaugcggcuagucucauggaugcaaucaaaggccuacuagacuugacaaaugauuacuuaaaaaaucuugaagcacaucacccaggaguuggggcagacuucuuagcgcuucuagcggacggagccucccgagcuaugcgcggagagcgaguuuauucuaauacaucaaaaguaugcgaagguagaaaacaaggaacacaggcaacauggacuga

SEQ ID NO: 234 - RNA, 598 nt, Artificial Sequence
  Synthetic
ucguuaucccggauucaucgaagacucugaauccacagcgaggagcuuccgagaauagagcaagccagguccugugaggugcuucuggauuuguaguaccguauaauuuuacgugugcuggacguuuagaugauacccgcucaaucucauucaugagcauuaacuuagauacuucaaccugaccaucuaugguaauaauuuuuuuuggaacuguaggcacaaggacugaaauccaguaggggccaggcucuagugacgcuccggacauaaaaagcccuccggaagcggaaagaaggucuucacuauauuucauguugcauguaguuauacaagcccugaucgccggagaucuucucuaaauuucauguugcauggaguuaaugcaaacccugaucacacuggcuuaaugagaccuauagaggcuggggagaccgacaaacguuugaguaccaccucucgaaagcccgcaggagugcuggggagaccgacaaauguuugacuauuaccucucgaaggccugcaggagagaguuuacgccauucaugaucuaggggaagacgaaugaauagucuguugucugauuuauuuuugaccucua

SEQ ID NO: 235 - RNA, 598 nt, Artificial Sequence
  Synthetic
cuucaaaugcugggguuucuaaaaguuuuaucaaauacucaacaguuguucgaaagucuccucgaauacuuaauuccuuuagggcaaccaccauauguuugcgcgaagcugaucuauuuucuccauaugcaaaaauaugaccaaauugacugucugagaaacuaugaauaccgccggcuguaccgacagagaaguauccccagacauucgaacuacuucggaaauuuaauucaugcaucauaccgcuugaugguuuaaagccuucuccaggaucuucagaagugauacgacaagcuguuguauguccuuuugguguuggccuucucugaguuucagaagaggauucuuuggcaaaaucaaaaucaauuucuguugauccuugagggucgacaccauacaacaaucguauaucacggauucuauguagaggaagccccauugcaauuuguaauugugcagcaggcaaauugacaccacuaaccauuucugugguaggauguuccacuuguaaucuuggauucagcuccagaaaguaaaauuuaucaucagcaugugaauauaaauacucaacaguuccggcagauacauaacccacaag

SEQ ID NO: 236 - RNA, 549 nt, Artificial Sequence
  Synthetic
cuugcuugaaauucuucucguggaauuucuucaagaagcugaguauccuugagacuagcucuaacagguaggggaaacuuuggacuauccagauaaacuuucugauaaugcgccuuaacuucguccuugucucgauaaccuccaauauggucugcuauaucugcccaugauccaaagccauauauuucggcucccuccaaaagaaguaauucuucaucagcaccccaguuucugucauauaugggaacugaauuuugcucuauuacucgguauggauggguuccuggguugugguugugugaagcuucgccauuugagaagcauagcacacaaagaucauaaucaugacagugagggucagcacaccuaauucgaacugucgagguaaugucugcugagcauacaucgcauacauacuuaacaccucccucggcaccucgggucgcagucuucuuccugauuuggcccauugcuaaaacucauggucaguacuagcaacagagcuccccuugguagcacgaaguuaaaacugcaaauccuuaaaauuuu

SEQ ID NO: 237 - RNA, 576 nt, Artificial Sequence
  Synthetic
gccaaugccuugagcgucugaacaagacuuccagugaguggucuaaacuucucuacuauauucucuucaccuucuucaucagcuucuaugucggccucgcaaaggcuagugacaagugucaagccacaaaggagaacuccaugauuucgaucugaaauaaguguuucugcuuuuucgaagaaaugcucuugaagaucuggcacuuucuugcaaauacgcauagcacauagagcagccuucuuacgaauauauggguuugcuguggaaaggagauuuucuaucucuggaaagagaucucuugacauuucgauugaugcgauguugccuagcguacagagggcuaguccgacuauguauugauuagagugauugagaucguucuuuaaggaguuuguaacuaagguaagaaccucuugauuuucgucuaaaagcaacauggucccuaaguaaccaaggcguuugucggcgaaacgaggagacgcaaguaauuuaaggcauucuaucuggccaaaguggguucuuuccccaagugugaagagauauaacaacuuugcaacguuauuacgucugacauug

SEQ ID NO: 238 - RNA, 595 nt, Artificial Sequence
  Synthetic
aacaccauuaggcccuaccaaagcuguucgagaguccauaucaacaccuagauccaaaugucuguauaaaucaucuuuaggaucaccagaguaugaaaaaguaacaucgucaaaugauaacacugguggaggaaguuuuuccacgucugcaaaucugaaaguaaagauacggucaggcucaacuuuuugaaugaagccaucugcuuccaucuugucuaguauuuuuugucgugauuuagccugucugacuaaguuggcauaaguaccagcagaugcaauaaauuuuuugauaugagcgauuucgucuuguugcuugugauaagcuuucauuugguugacuucuaacucagagcgggucuuuugguauguaucauaauuuccaccauaauauguaaguuguuuuugccgcauaucaaucauauuggugcagacuccauuuagaaaguccauugaaugagacacuaauacaagacuucgaucccacuucuuaagauauucuucaagccacacacaagcuuccaagucuaagugcgcagucggaucaucaaguagaaguaaagauggcuuaacaaaaagggcuuuugcuaaagcuaca

SEQ ID NO: 239 - RNA, 466 nt, Artificial Sequence
  Synthetic
cuuguuuauuugcaaacacuagaagcagagacuccuucauuucucgaucauugaugaugcggugcaauucuuggcgugcuucgucuauacgugcuuugucggacgagucaaccacaaaaaucaagcccuguguuccgcugaaauagugucuccauaaaggccugauuuugucuuguccaccuacaucccagacauuaaacuuaacguucuuguacgugacuguuucaacguugaauccaacggucggaauaguugucacaucuugguuaaguuuuaguuuauacaagauaguugucuucccggcagcaucaaguccuagcaugagaagccucauuucuuucgaaccaaagaucuuucccaucaucuuagaaaguugaccgcccauggugaagauguuaaguuccgaggaccagagaaaacucguguauccugaucaaugaacaauagcaaaaucuugaauacuuau

SEQ ID NO: 240 - RNA, 532 nt, Artificial Sequence
  Synthetic
ccacucccauccacggcacuacaugcaacuauacuccaauuucggucucuuagcucuccaaguuucaaggcuucacuuauuucucccgcacccuuugcaccaggcugauccuguuuguucgcaaaaaccaauaaagcuaaucgaucaauaucuguugagucuauaacgaagauaacugcagcgguauuggaauaguagcaacgccaauauggucguauagauguuuggccaccaagauccgcaucuuuaagcucgucuucauugagcauugcagcaaguucgucauacacguuuagaugacuuagaugaagagaaaagggggagaaagaacaagcuuuaggcuuacccaaacauuaaaauuuaaauucuuaaaggugauagauuccacauugaauccuauuguugguaucguuguaacaacuucuccaauuuuaagucuauagaguaaaguuguuuugccggcguuauccaagccuaggaucagaauucuuaucucuuucuuugaccacacuaaugaugauagcuuagaaua

SEQ ID NO: 241 - RNA, 562 nt, Artificial Sequence
  Synthetic
caccgcccauagcuccuucaaaaacguguuugacaaaucccucuuugauucguaccacuucaacgcaaucuucacgaucuugcuuauuugcuaauaucaacaaugguacaccgucaauuucuccauugaccaagacuuccuccagagccaaucgacacucuucaaggcgacccgacucaucaugcuccaaaucuccaucaccaaucucagugcuaucaaugaggaaaauaauggcguggcaugaucgauaguaagauuuccauaguuugcgaagagauuccugaccaccuacaucccaaagcuuaagguacaugucaggcagcguaauagugcucacauuuuguccgacuguaggucccguauuuauuuugggugcaggcgcaugaggcaggaacaggaauuuaacuuguucgugaaaaguugucuugccggcguuaucaagucccagcaaaagaaccgaguauucuucuuugcgcguugcguagugguagagacccuuaaccaaaugauacauguagguuuagaucuacauaaauggagaaagaaaucuuaauuagaaugg

SEQ ID NO: 242 - RNA, 568 nt, Artificial Sequence
  Synthetic
agaccuucggguacugcuacaacaauuacagugacugucacaaugaaaauuugcagaaauugcugaccuuuaacgguugguguagcaucauuguuagguagucuagccagaaacucaaugaauaagacuguaaauaauaauagaccagcuccuccuccaaguuuagcuauauacucugcuaaauuguucaauuuugacuguaauggcgugauuuccggaucuucacggagcgacauuaauguuuucccauaacuagaguuuacaccaguugaaguaacuaaaaauguacccacaccuucagugacaguagccccagacaaaauaaauggaucuaauuuuucuagcuuuucgugguucgagauagcagcauaaacuuggucugccggaugcuugcgaauaauaucggacucgccaguuauuugagacucaucacaucuaagauuaugcccuccaauaaaaauuccaucaacaggaaucaugucgccagguucaagauguaaaacaucgccuacaagaacaucauagauggauauuuccgaaguuuucccggaacgagucacauuuacau

SEQ ID NO: 243 - RNA, 596 nt, Artificial Sequence
  Synthetic
uguuaacagguauaccauccaaaugaccauuuacaccugcguaaauuauaggaaccauuucguuaacagccauuggugaauauugcuuuuguuucaaaagcucgguuaaucguucgccucgguugaguguuugcuuaguagcagcauccaagucggauccaaacugggcgaaagcugcaacuucacgguacugugcuaagaauagcuugagcgagccagcaacuugcuucauagcuuucaacugagcagcugagccaacacgagauacagaaagaccaacguuuauugcuggucugauaccuuuguagaacaauucagccucuaaaaauauuuguccauccguaaucgaaauaacauugguuggaauguaagcugagacaucuccuccuugagucucaauaauuggcagagcaguuaaagagccacccccguguuugucguucaucuuagcagcacgcucuaguaaacgugaauguaaguagaauacaucaccgggguaggccucacguccgggaggucgacgaagaaguagugacaucugacgauaggcuacagcuuguuuagauaaaucaucgaagacaauaacagcauguuuu

SEQ ID NO: 244 - RNA, 598 nt, Artificial Sequence
  Synthetic
aucagucugacugcuauacucacuaccagagucacugauuaccugucugucucuaucgacaauuccaugaggugauuuuaaaugagugauauguucgucaaugacacuuagaguuucauucauuacagggcuaucuugacgaugauucuuaauauuaacagacgagauacuuuuugauugaaucguuguuucaggacuaguaaucguuaaguuugacggagccuugauaccccggggcccaagaguugguuguauuugaggaguaucuaacauuuugagagguucugauggcaaggagaccguauuuucaccagaaaaaggaguuuguggagaaacuguguugcuaguuuuccuuauuuuggaaugggaauuuugaauggacgaugaugcuggcgagcauauuaaagauccucggggagcuauacguguguauacuucugggaagaggccacucuuuccauuuagcagaugacggccuaaaaaccauccguccccaaaaucaucaucacguucuaucaacucaacgcgaucuccuuuggacaagcucaacucaucugagcuacgagcugagaaaucaugaacuacaagcaaaauauga

SEQ ID NO: 245 - RNA, 598 nt, Artificial Sequence
  Synthetic
aucgugcugugcucgauaugaaagaacgagugacgaaaaauacuaguaaugauauacguguugugaagaagaauaggagaaauuuuaguaauuuuuacagaaucaaacauggacgaugcuuccuuuugggggcuggagguucuaaugccgccacaauagccucaucgaaaacaucuuuuaacuuguauugugucaaggcacugcacucuacauauuuuacagcaccaagaucuuuugccauucucucaccauccucucuuuugacugguugcauuuuuuguuugcuuaauuuuucucggacacuaggaucgucucguaaaucuguuugaguuccuacaauuaagcaugguacgccugggcaguggugaugaaccucgggaaaccauuucucacggacguuuucaaacgaggcaggagaggugacagagaaacacacaagaaagacgucagucuguggguaagaaagaggccgaaggcgaucauaaucuucuuguccagcgguaucaaaaagacccaauguauaaggcucaucgccaaucauaacaguaacugcauaguuaucgaauaccgugggaacauacucugagggaaauuuauu

SEQ ID NO: 246 - RNA, 597 nt, Artificial Sequence
  Synthetic
gcuucgcgaaaguaaggugcaaggaaaacaucaaagagggaaccaguaaggccuucaacaguaucugcgauaggaagaacugcgauacguuuggcguauuuuauaucaggacauggauguacuguaacaauaucaccauguuuaacccuaagguugugucggacaacacgauucauacgagcacucccgucaucuaaaucaucaucugcgaguacaauuaaaacaguauccuuucgcuucuuccccuuaacuaggacaguaucuccacgaaaaagcugcaaaguuuccaugguauuauuugacagugcaauaacagaguuaucaucguugauggcaucuguuacaauuaaggaauuuggcuuuuucuucuuuuuuaaaauagcagucgcaguagcaucaaucgucuuuuguucagcgccagaggcauccucaaguuuaacuguuuuuuuacgaguagcauugucuucagacauaguuguguaauaaaaguuaagagggcguaauuuccuagaaagaauauaucuacuauuaauuuauugagaucuuggaaugaagguuuauccgauaaaaucuguaaaugauggagcuaaucugaag

SEQ ID NO: 247 - RNA, 537 nt, Artificial Sequence
  Synthetic
ugcuacgcguauaugaggaauagcuaagaaaggguuggugugcaaacaagguagaaaacccguugauauuucuaauaccuugaggaauacugcggaauauauacgacagguguuaaaucgacucaagcuagaugaucaaguaaaauuaauuauucaauuuaacguauuuuaauuugauagaaauguaauccagacaaaagaaauuucuagauuacggauuauuugcucagcugaccgaucagcuuucuaguaccccgucuagucuaaucagauugacagaucagagacuaugaugaucaaaauuggaccgacacuauuuuugagaauaaauuauaucuaaaaguuauucuacugcgguacaggauguuuacuuuuaagguuuucccaucgcgaaguaguuaaauauugauaaaagacguaguagauaacaaauuuuggugagagaaguuucaaaagcgguucuuuuugugcuuagaauacaguuauguaaaagacgugaucaaauuuaaucguaaagacuaucaucguuaccagcau

SEQ ID NO: 248 - RNA, 594 nt, Artificial Sequence
  Synthetic
cgaccgauuaaucccauucuagacaagccaaaaucugucaauuuaagauggccuuucugaucaauuaagagauugucagguuuaagaucucgaugaacuaucccucgacuaugaagauguuugaccccuaggauaaccucaccuaaguauuuucuugcccaauccucuugaagaccgccuaaagccuuuauaagugacgcacagucgccuccauucaaauauuccauaaccaaguagagauagucuuuacuugagaauguccaguauaauuuagcuacaaagucacucucaccuugccacaucaugauugcacguucagcuuuaacguuaguuaccugauuuuuggcuaccauaucggcuuuuuuaaguacuuugauugcauaguagucaccuguagauuuuuucuuggcaagauaaacacuuccgaaugcaccuuuacugauagguuuuauuauuucaaagucuuuuauggaggguggaacaauacgggcuuggggaacaccgacaguugauaaacgaggugauggagguagucgagaugggucagagccugcagcagaagauugacgucuauggugaugagguagaagagca

SEQ ID NO: 249 - RNA, 471 nt, Artificial Sequence
  Synthetic
cugaauuucugaguuccgcuaucuuuuuaucucuucuuuccucaaguccguauugaaguucgugagauaauuuacuucgauucaucucucuuuuacuuucuugugccucccaucccauuuuuuuacauuucaucacuaacucaguuauuggcucuauacuguuagccccuuuuguuccugcauacaucucuuccauacaaaauuuucgcgcagucuuugcagauugaaaugccucaucguaauaauuuagcgccaguugugcuugggccaguuggaaauaugcuuucauauuugaugggaggagacguaaagcgcauugggcaucuucaauuacacgaugaugaagagauaauuuaagaaguaccauugcacgauuuguauaaaguacuggauuuuggggaucacaauugaucgcuuuuguguaaaacauuucagcacgcguauaaucaccagacuuaaaauauuuauuuc

SEQ ID NO: 250 - RNA, 560 nt, Artificial Sequence
  Synthetic
uugagaagcagccaaccauguauuaacaacuaagcuagugcuugcaucaaguuuauaugauugcguagacguguaagcaguauggauugaguuuaggagaguagucgaugagacuugcgcuggagguugagaaguagaauuguuauuucgaacaccuccauacgcugaagagguaguugaauagauagacauccggugaguuccagucauuuuaugaagagugaucgaguuuuuagaccuuuccacguauggauauuuaagguauguaaaugagucaauucaaagucacaagauucucgaucagucgauugauuggcuuauugacaauauucuuuagccgaaaucuuagacaauggcuugacagaauuaaugucuggucuucgaaguauccaguugguguguagcagauaacuucgguauaguuguagaaauggaaaacaaaccgcaaaagacagucuuguaucgaccgugaggccgacaguaggagaaauucaaugcuauugagaaauugaacaaccaaaaagcgaaaguaggguaacaaguuucgacucacagaccua

SEQ ID NO: 251 - RNA, 593 nt, Artificial Sequence
  Synthetic
auagcucgaaagcgauacgcagagaaagcuccggguaauacacuuacauaaccaaaugaacuuucaagaggcuuauccaauauauuacuaauuuuguacucaaaguuuugagcagcaacuaguggauuaaauaguuugcgaccuccuuuacccaacauugcguggauuuccccacacgcgccaccgagaucuuuaucguuauagaagccuucccauagcgccaauaaagauuuuguuccgggccugguuccagcaucaaguaaaauacauacuucuggauuaaguaaucggccaaaagcauuaaauagccaucgaugugaauuuauuuucuugcuauuuuuuugcuuuaagcaaaacaucaucuggacaggaggcaauguauuagagcuaucaucaguaggucgaaugaguuguugauuagcugugacggauaacuguguaguauauucaaaaaugugggcaacugucucuuuuccgucuacauccuuuuucauuacaccaucuugauaaauaccaaugguggcuagaacaucuagaguaucuuuaucacagggaucgauuccgucgaauacuagacauacaacaauuuuuug

SEQ ID NO: 252 - RNA, 593 nt, Artificial Sequence
  Synthetic
cugaugcuggucuuucucucucaagcuugaagaccauaacgccauuaucauguccggcugcaaacaaauuaauaguuggaugagcugcaaugacccaaaaucgaucauucucccuuuugaaugacugaacagaaguacguuuauuuaagucccaaacccuaauaguuuuaucuucaccgacagagaguaucagauccuggugaggaugaaagagacaacaggaugcauuuugaaagugaccacggcaaguaucuacuucccaugcuuuugucucacucauucgccauaacuuuacaagacgaucaucaccagcagauacaaucaaugguaagguuggaugaaaagcaacccaguuuaccccucgaucgugaccuuccaguacaaacuuuacaaccgcgucuguauuuccaaacauaucugccugauucugguuacuucgugacaucuggucuucgaaugucauugaguuaggugccgagugcuuuuugcguaacccugaaauaucccagacacggacugauugaucuagagaggccgacacaacuaaaucaucuuuuggaugaaauugagcacacaucguguagugauuguga

SEQ ID NO: 253 - RNA, 451 nt, Artificial Sequence
  Synthetic
gcucugaguugagaggcauuaucaguuugaucuauuucaucaauagggaaguaaguuguaucaacguuugaugauaguuuagguucaaaaggugcacgaauccuucgaagacuaucaaagucuacaccacggaagaacugaugugccuuaaucucaucagcacuuccccuuccuagccgauuuucaguauuacaaauaagacuucggaucaaauuuucagcuucuggcccuaauuggacaucaucugggaaguaaagaguaugucgccaguuaacaaucuuacgauaaguaucaugagaauccucagcgcaaaauggaggccauccaauuugacauucgaacauaaucgugccaaggcuccaccagucacaguccugaccauaacccugaccaagaaaaauuucaggugcuauauagucgggaguaccaacaguagaauaugccaugguuc

SEQ ID NO: 254 - RNA, 554 nt, Artificial Sequence
  Synthetic
cucaaaugggauccucaucgaugggacauuggaucagguaaaguccuaggaaaugaugcgguugaugagaaguaugauuauggguaugguuuaacuagcacaggagcgucaaguccauaucuaccuuuuggugcgggucggcaucgauguauuggcgagcaauuugccacauugcagcuagugacaauaauggcaacuauggugcguuuuuuuagguuccguaauauagaugggaagcaggggguuguaaagacagacuauucaagucuauuuucgaugccucucgcaccagcccugauaggcugggaaaagagaugacuguuaucguaauuauuuauggcagguguuaggguuagaagaauugucuaaagaagaucuacuuaauaagcaauuguguuugacaaacauagcguacuuaaggggcuugaaccacaaaucgaaaugcgcuaaauguaguuacuacccgguuagcagucuuuauuucaaaguagagacgggauaaauaagcaagcuuaaauucuaguguacgcgcuuaggaaccgagauacgaagac

SEQ ID NO: 255 - RNA, 399 nt, Artificial Sequence
  Synthetic
cgagcucuuauagugugagaucugcagcgaguaguaucuacuacuaugggcaccgaaaucuucgaucuuagauagugguaucguuugauaaccaucguuaguugacgauucugccgccuuguaguuuucuggauagguccggaaugcaccuauuucaaccuuaccagcugagauggugcgaucugggucaaugacaaccgcaagaaaaggauccgagaaugauugcuguauaugcugugugcuaacaucuaugccacugagccagcagccauagccuggaugacugugguaccaccccacugcauucucuaacuuuccuugcucucgacaugccuggagauaacgaaccauauauucauuugccucaucuugggcauuaacacgugucuccgugccuuc

SEQ ID NO: 256 - RNA, 529 nt, Artificial Sequence
  Synthetic
cugccuggaauuugacaacgcauguaggauuucauuaaguugagugcuaaaucccauuucgaaaagucgaucugcuucaucaaauaccacauacuugaccgaggaaaggucuaaugacauuucaaucuuaagguguaagaagcgaccuggcguugcaauaauaauaucaggguuggcugccauaaaucugaauugaucuucaagacuaucucccccuacaagaagaacgcauuugagaucagugcuccgagaaaauuccuuaacgacuuucaaagucugcaaggcaagcucucgagauggggauagaaucagagcucuagcaccaacucgagcacuaugcgccuucaacauuugaaucaucggaauaacaaaagccgcugucuuuccugaaccgguucuagccauucccacgacaucuugaugaucaagaaucagagguauuguuuuucucuggauuggagucggaacauugaagccuuuucuuuugauggcucucaaaagaugagcauccaaacccauagauugaaaa

SEQ ID NO: 257 - RNA, 597 nt, Artificial Sequence
  Synthetic
gaaggugugugauauggaucauagaguuuuauauaacgaucgcuagcacaaguuaaaagcuucuuaucauuuguccagcacagucccuuaacuauguuuucaugugcaguaguauuccaaguuuccucucgacuuauaagaucccacaccuuuacuacgccaucaccacucccgcuagcgaaucucuguaaggacugaggaucuuuagccauaguauagacuccaucaacaugaccuuuuccuaacugaguaaugaaaggcgcagcaaacauccuuucuaauuuaguagcauucaaagcccgaguauauucucucgcucuuucaaaaggauguaaagcaggauccaaguugcgaggaacuuuuuggacaucagagccagcuucuaccaaagacuggcgguugagugcuuuaaucuucauuuuuggcuaugugagagcccauacauagauuugugaggggaauuugauuucuggacauauauucacgagauuuuguauacaauacucaguauaaugacgcugauguauugaucuaggugaacaaaaaaauuaggugcuuuagauggauugggcccguagaugcgaauucagaugaauu

SEQ ID NO: 258 - RNA, 590 nt, Artificial Sequence
  Synthetic
accucacuagggccuucaguaguuucauuaauacuaguuaaagcaucuccgcuguuuucuucaccaauuggagccauuguaucuuuaaagggacaucgggcuguaaaaugcucuccauuacauauacgacauuuaacuuucuuaucuuuuaauuugucuuucauuauuccugccucuguuuuuucaucuuuggcaucuuuuuuccaguuggcacucggucugaaaguuauauuuucaccaauagaugugguugagcuaucugguccggguugaucuuuagcagagaguccaaauuuacuccacugcuuucucucggcaacucuaggauuuacaauuucuuuguguguagugaaacgaauucgucugguauauuugaucuuuuuuccaucuucaucgauucgauaacuuacgauaguuugagagccaucuuuauuaguuguuguaguuguaggaggaaguuguucuucaauccggucaacggaaagaucuucaucgucggcccagucagcgcgaacagauuguuuagacauuuuucaaaauauuuuaauuaaauacuugcaaauggaaagcuuguaaauucaagcaaguau

SEQ ID NO: 259 - RNA, 499 nt, Artificial Sequence
  Synthetic
aacaucaaugagggcgcggguuucaugaguuccaauuugauagaguaauacgggagaguugucaccgagaaucacaauuccgugauuuggagauggaauagggcaaucuaucagcucuaaagcauagaauuugcuuuuuacgaugggugacuugucuauauacugcuuucggaauuuagaugcauauccaucggcgauaauugugagaucucccaaauaguagucggcuucucuuuugccuguuuuaucauucauugucucugaccuuacgccaauuacaguuuggguuugaggauucguaauagucucuguaaccagcguuucaacaauuuugauguucggguucugggagcagcaucuacggagcugagauauuagucuaccauggugaaaagcucguccuuccggauuaccgcccuuaauguuuguauauccaugagcacucgcauuaucgguaucugccuugggauaagguauuuucacgccagugccauaauaa

SEQ ID NO: 260 - RNA, 491 nt, Artificial Sequence
  Synthetic
cacaucgagauauaaaacccgaaaauauacuucucaugaauagaacuccuacuauuaaauuaggugauuuuggcuuggccaagaucguuggugaggaaucauucacaacaagcuuauguggaacacccaguuauguugcaccagagauccuugaagacucagauaaucggcguuacaaucgagcuguugauauuugggcucuagguguuguucuuuacauuugccucuguggcuucccgccauucucugaugaauugaccaguaaugauuauccuuacacucuuguccagcagauuaaaauuggucaguucgacuucccaucgccauauugggauaauauaggagacucagcucuugaccucauugacaaaauguuaacaguagauguuaacaaacgcauuaauauugaucaaugucuugaacauccauggcuaacucaaagagaaucaacgacuuugccaggugauuacucugaaguucuugacgaacuu

SEQ ID NO: 261 - RNA, 404 nt, Artificial Sequence
  Synthetic
uaaaggaauugaaggaggaaaauuugaugauggauugauaacagacgguacuugcccauuuauacgaggugguagcugauaauuugaaaagugaccuaauugauuaugugaagauuccaucggggcccuguacguaaaguggccugcuaucuuugagagaccauuuugauaaggaguuuguugcagaccuagauaagauugaggaggcggaguagcucuccuuuuuuucucuuuuucaauagauauaccgucaacgauuccccaaguccagccuuuuccauccuuuucaacuuugcggaaagcaugguguugugauagauugugacgaacacuacuuugccagccuaagguuugaguuuuaaaucugaaauauggguauuuccuguauauagcucgguagaugu

SEQ ID NO: 262 - RNA, 424 nt, Artificial Sequence
  Synthetic
auacucaggaggggcaggggaaauuaggacagagucuuuugauggcucauuugaguugauuucuucaggugagauuguucguaugccaggggauuuuucguuagcuuucuccguaauuuuuucaugcggugacgaaaucaguccagcccgaugcaaguaguaguuggcuaucuuaagacauccaucuuccuguggcaagacaaacaucaucucuacuccuccaauuucaauaauuucgccacuagagagugaaauagaaucaccgcguuuaagaggaugauuauuuacuuugaucccguuacguccgugaacagagauguuccaugacucugugucagagucgaaugagauuucugcauguauucgggauacugucuuacucggaccaagaucaauauguacuguguuaucgucuucuugguau

SEQ ID NO: 263 - RNA, 448 nt, Artificial Sequence
  Synthetic
cuccgaucugcuaccugaauuuugaucuccacgaauguauuuucuccagaauuucuuaaugggcucauacacacuaaacugaacugcugcaugacuauugccaagcaggcugaugccagcgccccuauaaaagccuuucacuccuucuuucugauauaucaguuugacgccuugccacauauuuucguaggcuccguuuuucccucugucagaacugaccaugcgcgucuuuagaacccauauuggauugguggugagugaaaccaucauuccugagacugccgaugcaaugaaaaaaucaaauggcuucaguaaaucucguuguuugcuugcuuugcauguaucguuuggagcagcaagaucucuagccaugaaaauacgauaucugauaauuuggccuucaauaacagacuugaagccgagaaaaauugaccaacucccugaauuu

SEQ ID NO: 264 - RNA, 598 nt, Artificial Sequence
  Synthetic
cccaagagaaguucuggagcuaaauauucaggaguaccacagaauguauuuguucggucuucaucuuucauuuccauuuuacauaguccaaagucgcauaaugcaauauggccagaauaaucaagaagaauauucucggguuuuaaaucucgauagaucacauuaaauccauguaggcauuccaaagcacaaaguaauucugcaguauaaaaucucgaucgauuuauaucgaaccgcuguucuuuuugcaagugauggaaaagcucucccccauuaacaaaagcuaaaacaagauaaagcuuuucaggagacugaaauguaaauuuuaaggggacaauaaaaggauuguuaauuugagagaggacugaucguucugcuagagugugugcaacuucugagcgagaaauaauaugggcuuuucguauuguuuuaagagcguagauucuuugaguaucuuuuuuuuuaacuugcaugacuuuuccaaagcuacccuuuccaacaacuuucaagaguucaaaaucuucaauuuuaaaugacuguguuuuuguuucucgauaaucuacuccgauccgaauuuuaccagaaccauaugaaauau

SEQ ID NO: 265 - RNA, 595 nt, Artificial Sequence
  Synthetic
uagccaguaucuguuaggcgaaaaaacaagcgcauggaucaaaucaccagcauugagagaauauaaaugcuuagacucauuuagaucccacaacauaguagucccaucuuucccaccugaugcgcagagagaaccguccggcgagauggugacaguauuuauguaaccauuguggccaauauggucagucuguaguuuacaagaggauaauucccagaccuucacaaguuugucccagcuacugcugacaaugacuggauuuuguggauuugggcugaaucguacacaagauacccaaucauuaugaccuuuuucaguaauggugaacuugcaaucaccuagaguauuccagagcuuaauuguucgaucacgagagcccgagacaauuugccuguugucagcggaaaaagaaacagaaagaacaucauuuguguggccgacaaaucuccuuguugugguuccuguugcaagcucccagagucggagaguuuuaucccaagaagcagauagagcauaagcaccaucagaagaaauuacacagucggaaacuauaugagaguggccaugaagugaucgcuuuggguaaccguaggaa

SEQ ID NO: 266 - RNA, 590 nt, Artificial Sequence
  Synthetic
ccgaugacaaggggagauccuuuucuugccgcaauuacuucauggggauaauggacugauuuuaguagaaguccaaaugcuccuugcagcuccuugaugacggccuuagcuaaguccguaaaaguaauuguugggugcuggucauauauauacuuagcaagcuuggcaauacacucaguaucagucucugucucaaauuuauggcccuuugagauaaguaggguuuugagcucuuuauaguuuauuaugauuccauuaugaacaacacugaacugccauuuggggucacuacgaugaggauggcaauucaaucuugauggagggccauggguggcccaucuaguaugugcaauaccagcaugggagucaaaaacuuuggaguuaucuaguugcgacuccuggacaaguugcuuuaauuuugcaaccuuuccaacuucuuugaacgcaaaaacuucaucuuuuucauccccgucaauugcgagcccggcacugucguagccacgguauuccaagcgagagagaccguugacaaguguuucaagaauguguuugcgauccuuuucaaugagauaauuaauauagccaaagau

SEQ ID NO: 267 - RNA, 598 nt, Artificial Sequence
  Synthetic
ugguccgguguaaaauuccuuaggguuaaguaaaaacauacauugacuaguuaucaugaucauucgcugaaaauuucaagucgaaucuucuuagugguggcucuauauaacaccuacgugugcggcuuaaguaguugaagauaaaauuuuauugauuuaauuuuauuuuucauucuuuugagcgaauaaagacaggauuucuuucgagaggcacuuguucucaaaauuauuuuuggccguggcacagaggauuuuuuuuuuucauccuaguagauaaucaaauuagguagcuuuggcagcuuuggccgcucuaagcaccuucuuucuuugagcaaucaugugggugaauaauauauaugaaccuggaauguagaucaaccgaguuauuuggagaaaccaagcaaaauucuggugaagugugccagcaggugcaauggcuuucgagaguaaccaacauucgcuacuaaugccaagcggguaaagaacguaaaaaguauuauagcggagccacauaauuauuuuuggguuauagccacugagauugaagacgaaguaugaauaucggauaacuucggucacacuccaagcaaucaacaua

SEQ ID NO: 268 - RNA, 597 nt, Artificial Sequence
  Synthetic
uuauuggugguagaauguucaaaaccucugauauaaguucauaguauuuuugcuuggauuuuuuguugagacuccugaagaaugaagcgaaagcuuccauagcggccagucggacugucacgucaucauccuuaaaucccuugguaaaagcagaaagaacaguaucuucaugcugcuuuucgauuauucuaggaguuguugagaagauucuauaggcaaucucacguuggcccaucacuugcgacauacugaguguaaagagaacaccuagaauuucgggccauugcaacuuaucaucggaguacugccuagcgacuucugcgacugcaucaccuaucuuauuucuuguagacguuucgguuucagagcuaagggcuucaagaaguuuuugucugauaauauguccuuguucugucggcaaagagauaaauguuuccacugacugauuauuuuguaauuuucgagucuuugaagcuauccgucugaagaugacugcagcaaaagagcguuucgcaggaucguuugagcccugaauuuguuccaccaggccaaucaagagcaucucugguuuaagcaacguccaauuauucguuaaau

SEQ ID NO: 269 - RNA, 598 nt, Artificial Sequence
  Synthetic
gguuugaggaaaugccccauaauuccaaagauagccuuuguggggaaaacaauugcgaacaaaucgaaguuucccuuuuuugguauccuguuuuaucggauuaagggcuugcuccuugcagauuuccaauuuugcauuaguccaucuagggauuuccacaaucauguuuaguauugugcccucaggauuagcguagagugguauaucaugaaaaggugauaucggauuuccaucucuuucuauauauauucgauaaucaagaguauugggcugagcaaucuugcguauggaguauugagaagccaugauguuaguuuuuuuaugaaaaacucgaaggugauuugcuaguugaguggaacgugauauagccugagauaaaggcgccaggguugacgagacuuggauagaaaugaguuaagcuguuaguauuccaaggcgcugugguuuaucauuggaaacgggaaugcacauuaguaucauaacaaugccugucuguuuaauugucagucagucagucaguuagucacguggggcagagagcaagcugcgcguucacagcuagcugacaacauggagccugcuuuaauuuaauucuuug

SEQ ID NO: 270 - RNA, 526 nt, Artificial Sequence
  Synthetic
auaucgggagggguggcgguaaugaggaaggcucuugagcugcuaugagagauggugaugauugugccugauguacuggaaguaaugguagugaugauguuugaguaacacgaagagauguuggcgauggagcuggagaaacugagggauuuuuugguauuugagagacugugaaagauugagguuguggacuauuuggcucucuauucuuuucacagucucgaguaguuauuugaacacuaggacguaacgaggaaggaggcaaaggagguguugcugaugcagauacuaucggaauuuuuggagguaauuggggaggagggagaugcucacuuuuagcaagagggguugugacuugggaagaacuuguaugaaaaacacgaguuaaaggugguauuguuucacguggugguauuaaaggccccgcacgaugugaaauaaaagauccaguguuuuucucaccugaaaaagguggugguacguugaauuuagagacgcccgauuccgaauuuucuuuagaauuuuu

SEQ ID NO: 271 - RNA, 595 nt, Artificial Sequence
  Synthetic
uuuuuuacagccucuuugggaaaucuuauggauugaggcgaaggcggaacuucauuauauaugauuuugcaaaugugugaaaagcuugagcucgcaccuuucuuuguuucaaaagcuagccgaacccuuaugacuucuaagggauaugugaagaaaacacuagcgacgccugcuaaacugccacuuaacaaucuucguaaugauguuucuugcguaggugaugauauaagaaaugaucguauuugcucguagguuaaaaacuugaucgcagcauaaggaaauauccgaauuauaguggcagaauggccacgaaauagaccacuaauuccaucaguagcuuugauuugccguauagcagucacaacgccgagccagcucccagcguaucuggaaaauuguggauuagaagauuggaauaauaucuucacacgaucuaaaggugccacuauaguuuuugccgcacucccugcuaguccuccagcuaauccugaccgccauaugaaucccaaagauugcuuuucaugaguuugggauuuugaugaaucuuuuuuauuuuucguagaaggguauacugcaauauuacuuucauauaaau

SEQ ID NO: 272 - RNA, 598 nt, Artificial Sequence
  Synthetic
ucugucuaagagugguggugaaauaguauccagacuauuugcaguagcgauaaacagaacuuugcuaaggucuacuggaauauugacguaguggucuguaaaacugugauucugcucuggaucgaggacuucgagcauugcagcgcuaggaucaccuuggaaauuagaacucccaauuuuaucaauuucaucuaaaagaaaaacgggauugcacacuccaacuuucuuaagcccuugaauuaugaggccuggcauagcugcaacguaaguacgacgauguccccuaauuucagccucaucccgaacaccaccaagagaaauucgaugaaauuuacgaccaagugcuguugcaacagauuuugcgaggcuuguuuuaccuacaccuggaggaccaacgaguagcaagauaggcgauuuaucaaccauucucugacuuuuuaagauuucuaguuuuucaugugcucuuucuucagaugccuucuuaaucuugaugucaaugucuugauuuauugauugcuuuaguuugagaaccgcuaaauauucaaggagucuuuucuugacuuucuccagaccauaaugaucaucaucaaauugcuua

SEQ ID NO: 273 - RNA, 517 nt, Artificial Sequence
  Synthetic
cggccccaucgaaccauacuuuuugcaaaaagauggcaucgcauagaauugagcaagcaagagauuaucguaaccuuccauaauaauaccaguugagauagcaacacuauaaacagcagcuggccaccacaauuuuagagcuucguugacagucauauucuuuucaagcucuuccgcacgaugggcacccugagugguauaguacugacucuuuuccaaagaaggagcucggccaauguccuccucaugcuuggcaguaguuucaagaauggacuugucgauaauagacauuuugagaguugagaagucaaaaaaauuuugaaguaaagaucagacuaaaggugaguuuggggauuuaaaaaaagaauauuaggguaagguuaugauugaguucacaagggaauagguuuucuagaaagagcaugaaggaaagacauaaaaccugagagugauauuuggauaauuuugaauuccaucgucaacagcuucgggagacaagucuuuauagaauucugau

SEQ ID NO: 274 - RNA, 529 nt, Artificial Sequence
  Synthetic
uugagccaaaauaagaaacgacacguagcuuuggagcccauuuuuuaauuucucgacgccaauuaaggcaagucgaauuaggagcuacaacuaaaaagggccaacauuucgagugauuuuugacaauugcuacgauaaaggcaauaauuuguauugucuuuccuaagcccaucucaucugcuagaauaacauuuuucuuuugauggaaguuauaaaguagccaauuuagaccuuccauuugauauugcaucaucuuuccuccugugaguuguagagguugcucuuucaucucaacucuucuugaaaaauuuaauuuucggaacaucuguaagcgaugguccauagcugaaguugaggauugccuaaaguauuuuccaucaauaaauucauuauaggcgguaauaaagcuuugauaucuuucgauauucucaauuuuugggggcuccauccauacugcuucaucauaagcaagaccuuugaauuuuacaaagacuucagugaucauauuagcagcagccuugucuaucuu

SEQ ID NO: 275 - RNA, 483 nt, Artificial Sequence
  Synthetic
aaagcuccagcugagcaaugaguaaguggaucguaagccuuugauggguucagaaauguagauacagauucguaugcgagaaguugaagugcuguaaaugguacagucauggaaagaguaguuggauacgagauauagaaggcugugaugccuucagugcgauagauauagcgggcacaaucacucagugaucuauaaauuuugcgagaguuaugcauuugcauucuuugcuuuauuacaucaaauggguucauuaaagcaucacuugcaauuguugcgcaugccccacuuguaaugcgcaugccccacuuguaacuauguagcuucaguaagugcucaauaucaaggauaaauuggcgauguagucauauaugucugauuccuuaaucaaaauucuuaauacagaccugcugcaauaggaugaugagcuccuguuugauuaccucccaugagauguuugacagcuucauagguugcaaaaua

SEQ ID NO: 276 - RNA, 598 nt, Artificial Sequence
  Synthetic
uccagcccaaaaaggaaggaaaugauguaagcuccaugggaauucauaaccugagugagcaucaauagcuuggaauagucgacagauaauccaacaauacaucguaacuaagugaagauugccaguuaucagacaccauacaguuggcauuaagacuguuccugcgccaagaaccauuguuucuauuggugaagcauauucagcugcuaguccgaagggugcagaguaaugaugauguauuuuaugaauauguuuguagaaaggaccccaaugaaauaaucgaugcauccaauaaugccacguaucuuccaacacgaaaaagaaagcaaucugaagacacauaguuuuuaaugauggaaaugggacaccaacauccauaccacaagccuuugucaauggaugaaaaagccaaauuugaggcagcucgacagugaaaugacuuauuaagaccaguuuuguacauucccauuguucuuuggcaguuggaauuuucugacccugaauuuuauauuuguugaaauaugguauauauccuaugaucacccauggaauacuucggccaaaauaaacaaguucaugcauaacaaaacucauaaua

SEQ ID NO: 277 - RNA, 511 nt, Artificial Sequence
  Synthetic
auuucucauucgcguaguugauacagaauugcucgaaugaguuuuuugcaaaguguucgaauccauaaauaucuaaaacuccuauaaaugacuugacacggcuuaagacuucuucagcagccaacgcauaauugauauuuucaacaagccagucaaaaagacuugaauaaacaaauuuagcgaccgaaucucgaacaacaauggcuugcuguuggcuuaagcuacuaacgacuuuaucuccccggguaauuaauugcuucuugacuguccaucuagcaaauuccaccggaucaaugcccaaaauugaagcagcaaucucuagagaaggcucauuaggaguaagugaagauucauuucuuguggcaguaaucuuaacauuuccaagauguaguaaugcugcaaguauuuuaaauauuucggucugcugauccuguuugacuccaauuguugcuagggacuuuuugagugcuucgaauucggcuuuaucaucaacuccaucuauugaagguga

SEQ ID NO: 278 - RNA, 473 nt, Artificial Sequence
  Synthetic
cuccucguauuccacuucucauagcgacuaugaagaauccaucaacuucaacuuuacaaaaagcaauacaugcacuuucacaaacuacauucgucgcggaagugacaucuccuguguuagcucuccuuacgccuuuacuagaaagaucucucaacacuccaucaaccacucaggaaguccuucgacagacaguggucguuguugagaaucuaacuaggcuagugcaugauccuguugaagcacgaauauuuuugccaaagcugaaaccuggaauuagagguguaauagaucgcgcuucacuaccagaaguucgccaauuggcacagagugcgcuaacuguuauugauaaggcuaugggcgauuauaauggugcuacugcugcuccggguaucauaucccaugucacuccacacgagguuucucucauuuuagaaacucauguaaaaaaaacaagcucuauaguugauacugau

SEQ ID NO: 279 - RNA, 598 nt, Artificial Sequence
  Synthetic
cgaugccacauacgacuugcaguuuuuaaaaauccaaauaauaacagcucaaaaucuguaguuucugcgucaaaguugcgaaguauuauacagaucauuggaagaccaucuuuacuuucgccaccaucauaaagugcacgaguugauacaagggacucaguauuccuuccagaauuuuggagcauaaaauguugaaaucgugaauaugauacaggacuauuuaaggagauuacugggcgguuccaggacacauccauugguggugguccaagauucguuaugagccuccaaagcgcuucagauauugauaucuccacuacaccagaaucugucgacggggcuauugcucccuuccucuccagaaguccuacuuuuugucgaacaugaucccaguuaucauauaagaaucuaugcaaagcaacgcaugacccaaagucaaaagauucagucucgauuucagucucuacugcacuaggugagaccgauaucucacggagaaacguugugacccuauauauauucugagugagaaaaucauuaaguggaaacauguaugguucuuuagcaccaaauagaacauuguuggcaagauuuugaa

SEQ ID NO: 280 - RNA, 598 nt, Artificial Sequence
  Synthetic
ucaacggaugguuggucauuaguuuuuagaucugguguagacgaagagucuaucuuuuuugaaauagacgguggacuuucaggaguaggaacuaaaucuguuguugauuuauacgauaaaagauuccgcucuguucccauagauggugcagaagaaaaaagcuuauaggaauuaucugucaugcgugguaacuuccaugggaaucuccguaaagucaugcagcaguaaauaaucgcgagugaccagauaucugcuggcugugggucauauuuucucucuucguaaacuucaggagcgagauacggauccgauccuacaauaccacuugcuuuaguuauaccagauucaaaaggauauuugaagacacucgcacucccaaaaucuauuaucuucaugauaccaugcucauugaccacuacguugucuagcuuuagaucucgaugcgcaaggcccauacaaugaagguaugugaccgcguuuaaaauuuguaaaaacgaacaaguuauuucauuuuucgacaucuuuccggucauaacuauugcgaaaagaucauauggagcguauuccauaaccucguaccauuuuucuuuuucgcaaa

SEQ ID NO: 281 - RNA, 597 nt, Artificial Sequence
  Synthetic
caaccacugagacuuguucaauacaugauacacaauagcaaucacuaucgugacagcaauagaauagccccagacaacaauaauagugacaauggagguucuuccgucaguagauaaaagggaguuuaauguggcaggaucugaaggcucaccagcaccgccaguuaaccaaccaaagagacagaagagaguugcaaguacaucaacaccgaauauagcagcaacgagugcaaaugcaggauaagucucaucuccucuggugacaaagaugagccaguuuucggugagagaaauuugaaggaauaacauucccuggauagauccaaaguuaucaaucaugccaccauuagguaagaaaagcgagccacguaauacccauguuccaagagcaagcaauaugccaagaacaacagagauaauccagauuuuagguaauugccacucaacaggucgaaucucaaagugagcguugucguaugcaacugcaauuguggcuaaaucggcaaaaagugcaaggaagacaauuaaaucaacccggacaguuucguuaauaaugaucauagagguuacaagauagauuucuaaguguaaacauaa

SEQ ID NO: 282 - RNA, 558 nt, Artificial Sequence
  Synthetic
uuccuguguacuuccguuguuuaccaagacuuucuacaaagucuuuuccaagcacuuugaggaagucguuaccaaaaaucuguugcgcauagcccucaaguucuugaagagcuuuugauggaggaucgcguuucucuuucucaaauugaucugaaacaucacagagaaaguuuagccuuuuuaugggcgaccaaaagaagggaugagccaugacuugaugagcuugcggucggcacuuugggucugaaucaagcaugcugccuauaaguucuuuggcuucauacgcauaguuaccuagaaucucaaggggauuaaggucauacauuccuuuccuaauauuuacuucucucauaaagcggucgccacaaucaaaagggugauuaccucuggugagaacauaaaaaaagauaaggccuagggaaaaaauaucgaucgcccgaguggcacguggauugaguaaagauccauggguuaguagcuuagagucggaguuguucuccgcacauauaucagcuaaaucagauucuucaucuuuuacgauuucacuuaggaguaauu

SEQ ID NO: 283 - RNA, 460 nt, Artificial Sequence
  Synthetic
uucuuuguuagacguauuugauugguaagcccaauuaacgcggauuucugcuugaugaacacgucugccauucaauguuugcaucgcucgcucggcagauccuggaucaucauacucaacaaaaccauaauuaaaucccuuagaagcaccuacguucuuaucaggaauaaucuugacguuuugcacaugaccaguuguuucgaauauuugucguaaaacauccucuguaacucggggaucuaaaccuccuacauagagugcccuuuuauuuggcucaggagccgcucuacgagaaaaagcuccauuauuguuaggugaaaccacagucccguucucaccuauaggcgaugugauagcugucgggauuggguucguguuuugugguaugaugacaggugggagugguggaggaggcauguguugugaguuuguuugguuaugacuguuacggcuauuacga

SEQ ID NO: 284 - RNA, 521 nt, Artificial Sequence
  Synthetic
ugccccaugagagaccgccaauaaagaguuuaggcauucuguauguuaauuuuuauccucgcgaaccugguauaaagucuuaaucuccgcgugcauccuugaauaaaaugugacaacgccaucgaguuugagagggagagagaaaguggauacggaacaguuaaagaaaaguacaucgggauauaacaaaaccuccguguagcauacaaaugaggggacgaugaauauauuuguuugcuuggugaacaggccggggaggauugggaugaaguaauguuaguacacacugucagagaacuaacgaacuucuagugaguugcucaagaagagcaaagugcugcguuuauagggagaccugaugaacuuuauuaauucgguuuggaggagcaauuuuuauaauggacuggaguaaccgaucagucaauuucgugauagaacuauucuuccgcaaauugagacgcaaaagcucucugauugugaugacaagaguuuugcgggucucaauaaaggaauugauguuu

SEQ ID NO: 285 - RNA, 591 nt, Artificial Sequence
  Synthetic
ccgaguuaaagcuacauuuaaacgucuugggucacuuaagaacccaauuccuugauggucauuugaucgaacacaugauaaaacaaugaagucuuuuucacgcccuugaaaagcaucgacugaagcaacuucaauuucccuguaguuuucuuuuuuaaaaguaccaguguuuugcauagagcuuacaacguaacuucgcugaccuucguaagguguaauaacuccaauaucggcaggcugaacaccugcuuugaaaaaucggguuacuauuuuuucaacauuagaagccucugugcgauuaagauaugauguuccugaagcagaaaucucuucauuuccgagauuagaccaaaacaucaucgguguaucuccaacuggccaaggaaagucaacuucaucucuaagccgcucuugcaucgucacaccauucuggagaguuccuucauagaacauauuugacggaaacucugauaggcauggaugcauacgauacuggauauugagucgaauagggugcauuuccaacaugacuagacguucaaaaagugacugauuuaaaccugcuuuggcagcuuuuuuauucauaauaac

SEQ ID NO: 286 - RNA, 598 nt, Artificial Sequence
  Synthetic
ugaccauucgaucugaagccauuaaauuaagagcacuccaauaauuagguaguuuaagucaagauauguaagcuccaaugauagcgagaaucaacacucuugagguaguaugacuaaagagguuauacgugucaacucauucaaucuuauaacccaaacacagcaacucccuauucucuaauccaauuuguagacguuaauuaaaaagaacgaucaagacuccgaaucuuucaaauucaacaaagacagaccgaccccgaugcaaucucauuauucacaacacucacgacgccaguuugccuucucccaacuuucaucaauucuuuaucacguacgacagcuuccacaaccucggaaaauacucgucuuacauucucucgugucuugcugcuuacuucgcaccaaccaacggcuccucuaaucuucgccuuggcacuagcuuccucgcugcucacucuucuuaaccccaagcucgcuuuaucacauuuacaaccaacaagguaggucacagcuccagguauugcauuugucucuacuucaucaaaccagcggucaagagcgagaaaacuuucgcgauuggaaaugucauacaucaaaa

SEQ ID NO: 287 - RNA, 594 nt, Artificial Sequence
  Synthetic
cgcgaguaagauuauaugacgaccauucuucauuagaaaacgaucgacuuggggcuuaauauuuugaacgcuuugugcauuagcuuuaagccaugcgacaucuauuucaaugucaaaguguccaauauugcaaacaauagcaucguuaggcauaacuucaaaauguuuuccuacuaaaaugucacggcauccuguaguaguuacgaagaucugagcuugacuugcggccuuuuccauuguggugacuuggaagccagaaacugcagcuuguaaagcauuuauagggucaaccucaguaauuaguacacgugcacccauacccugaagagcuaaugcacacccuuuuccaacaucaccaaaaccagcaacaacggcaauuuuuccagcaaucauaacaucgguggcucguuuaauaccaucgaucaaagacucgcggcagccauagagauugucaaacuuagacuuugugacagaaucauugacguuaaccgcaggcacgagcaaaguauuguuuuuuaacauuuuauauaaauggugaacuccaguagugguuuccucagauacaccaaagcaaccuuuuaacauuucuggaua

SEQ ID NO: 288 - RNA, 598 nt, Artificial Sequence
  Synthetic
gaccaaccacagcacauuucaaagacaaguacgccuaaugaccaaaagucaaccaucuuaguauauccuguuucaucuaggagaaccucaggagcaagguauuccgugguaccacagaauguauuugucgucucauuuuuggucaaguuagcuuuugaaagaccaaaaucacauaaagcgauauguccauuagcaucgagcagaauguuuucagguuuuagaucgcgauaaacgaugucauguuugugaaggugcuggagagccaaaaugagcucagcuauguaaaauuuugcucgcucuucacagaaccuuccuucucuuuguaaaugccaaaaaaguucgccuccagacauauaaucaguuaccaaauagagaucacuuggaguuuggaaugaaaauuuaaguccaacaaugaacugcgacucugccauagcuguucugacuaagauauuucuuucgccaacaguaugggcgaccucuuucuuuuguacaauaaccuuuuucugaaggacuuucauggcauaaauucuuccuguaucuuuuuuccugacuugauaaacuugaccaaaaguuccuuuuccuaucaguuucaagaauu

SEQ ID NO: 289 - RNA, 447 nt, Artificial Sequence
  Synthetic
uuuuaggcguuacaaucuucaauaaauaacuaacaucgauaacaggucguauaccagcagauacuaguaaagaaacgaagauuuacccccuuccucauaccuauguaguuaaggacaucgucccagaucucacacaguuuuacaaacaguauaaguccaucaagccauaccuucaacguacaucucccucacccaaugguaaagaauaucuacaaaguaaggaggacagaaaaaaacucgauggguuauaugagugcauuuugugcgcaugcuguucuacuucaugccccucuuacugguggaacucugaagaauacuugggcccagcuguucugaugcaaagcuauagaugguuagcagauucucgagaugaaaagacagcugagcgaaagagugcucuggauaauaguaugagucucuaucgaugucauaccauauuaaauuguu

SEQ ID NO: 290 - RNA, 527 nt, Artificial Sequence
  Synthetic
uugagcuucuggguguuuuguaagagaguuuguguuaaauagugucuguauagaaauuuugccaucaaaagacgcaguugcagaaagugcuggauuaugaggaugaaaucgagucugaaagguccaguuuguagcuucaggaaauucucccaggaguucuccaagcuguggguuccauaagauaguucuauuaucuuugccacaugauaacagcaaauugcugucuuguugacaccaugagauugauaaaauucccugauuauggccuuguaauguacauucuggugcauuggaauuucguaaaucccaaagaagaauaacugguuuuguaucaucagguguugcuguuaguagcuucguugaauuuucuggaucccaagcaauagcuccaacagcuuuacgauuguuauucaaagucaaugacgcuuuuuugguuuuuaagucccacacuguaacaaauccuccaguuccaccaguagccaaaauaugaggaacuuuccuauuccaggcaacacauucaaggucau

SEQ ID NO: 291 - RNA, 574 nt, Artificial Sequence
  Synthetic
auaaaccugccuuagauacuaaaucaggaguuggcguuuuaugggauucuauuagaguuguaaauuucaaagauacuuugauuggauuuucuuagauuaaccucgacgagaaucgauuuucuagauuuuuggcuaaaucauacgaauucaaauuuucuuaguaaauuggacaaugcgcgccguaaacauaucgggaugaaauuuuuuaauaauaaaaucaauugaaaauaauaaauuuauauccuauuuaaucaccgccaacaagaaguucguuuuccuuaccuaccuagaauuaguuuuuagauaucguucgauguuucgugaauuucaaauccagauguugccgccgauuuguucuugaugcaccucuagcguaucuccaucugccauaucgagaaacucaggacuaucaguuuguugaacacgacucccuucaaauaagaaucgaacagaagaaagugauuucccuugccucucacagaacgcguccaucaauuucuuaagugguguuguucguuuaauuuugaagaagacuucauuauuguuaucuguaaccuugauauuuaaauguuca

SEQ ID NO: 292 - skipped

SEQ ID NO: 293 - RNA, 463 nt, Artificial Sequence
  Synthetic
guaggagaugaccgugacgcauuaauuuuguuauaguaccacuugucaaggaaagauuugggaugguuagaauugacaguggauagcugacuguauucuggcauaugcacuaaauuaggccacuuuuccuuuguuggaacuccgaguaucucaacaauucucugcaucugauuuugcuggaacggaaccacuuuuuuggcuucgaucuuagcuucuucacccuuaaauauuggucgcaaugagagaaguucagcaaauauacagccaauagcccacauguccacggcagggguguaaugucuagagcccaaaagaaguucaggggcccgauaccaaauagucacaacaaccuuaucaccagugaauaauggaugaagagguuuaugaaauauacgagcaaggccuagaucgccaaucuuaacuucaccagaugagguaaccaugauauuugcugguuuuagau

SEQ ID NO: 294 - RNA, 456 nt, Artificial Sequence
  Synthetic
uaauacuucaucuggaagccaucgaguuugcuuuuuauuaucugaauuuuugaggcauuaaacuacaauaccuauuaagguucaauucaacguuacaguauguagcaguaaauaucauuuuugguauaagaauaaaaauauucaaauuuuuaccgaaaaaaaugaagcaguaagucauauuucugggucaagucucuguaagucuugcgcaucaagcuugcaauugagacuccaaaugugacuggauauguauauauauauauauaugguguuauaguugucaaaucgaaucuauucuauucuuugaaucagauguagaccagaugcuguuucuaugauuugacucauuucuccaacuuugaguucgaaugcagcaucuucgaauucuuucugcauaucaccucuaccaaagaaaccaaggucaccuuguuuuuuagcacuauugcaaucagacuc

SEQ ID NO: 295 - RNA, 586 nt, Artificial Sequence
  Synthetic
accugaagcaggucuugaggauguacgggaugagauuugagagucagguuucguaauaaauagugauucaaaagauggaaauaugugagagccacuaguauuaucucuagaugcuguugagaagucuucaucuucgucauggccauauucaagacuccaguaauuaggauuugacuccauuauacuuugugaaaucugcgcacgcugagcgagcuuacgaagucgucgucguuccaucauccgaaaauauuuuucaucaucauaacucugcucuccaauuuguucucuuucaauccuucgucgcucguauaggcauauuugggcuguuccuuucuuucgccauggaauuucuccaaguucgacauguucuaaaaucauguagaucuucuucaacucaggaucgucaauaacuucaagcaggccuaccacauuggcaugucggaccuuuuucagaauagcaauuucgcgcuucguuuuauucucgggugaaaacguaacucgacccagccuacgcuuuuuugaaaaucgcugaauaaucuuaauagccacaaaaucuccaguuucaagguuucuucccaauuuaacu

SEQ ID NO: 296 - RNA, 590 nt, Artificial Sequence
  Synthetic
cucguccauuccuucuccaguauaccaauguaagaaagcuuuucuucuaaacauagcugugaauugauccccaacgcgcuuaaagaguucuugaauggaaguggaguuuccuacaaauguagaugacaucuuaagaccacgagguggaauagagcagagugcgguuuguacauuauuagggauccacucgacaaaauaugcagaguucuuauuuuguacauugcgcauuugguccucuacuucuuucauugauaccuuaccucgaaauauugcugaacauguuaaauagcgcccguuucggaaaucagacgcugccaucauauuuuuggggucguacauuugcugagucaacucgggaacaguaacugcgcggaaagagugggcaccgcgacuuguuagaggagcaaauccaaccauaaaaaaaugaagacgaggaaauggaaccauguuaacugcuaacuuucgaagaucugaguugaguugaccugggaaacgaagacauguuguuacaccugacaugacugcagauaccaaaugauucaaaucaccauaugauggguuugaaagcuuuaaaguucucauacauauuu

SEQ ID NO: 297 - RNA, 573 nt, Artificial Sequence
  Synthetic
uugguugaagaagucggcgcauaacaucuaaaacuguuguuuuucguacaguuuuggccugcucuacguuauggccaguaaaaggcguguaugaagucaugagaaaaugacagcggggaguuggaauaagagaagccacaaugcuaauaagaucguuaugcauguagccuggauaucgaagaguuguugugcuagccgacauuacuguagagaccaauugguuagucuguugaaaugaagguuccugaacauguaggcgaucagcugcaauacgagauaaugcaccguuauccaaaaccacaaccgaguccgcauuuugagucaggcgccgcauggagaguagacuguuauauggaugaacaacaacaucgcccgaauuagucguaucugggaauacagaguaagucuggaugaucuuuuuaggaaaacggucauucagucguuccaggaggaaagaaccgaggccggauccuguuccuccagcgaucgaauguaaaaucaugaagcccucgagugaaucacuaccaucagccucacgaucuaucaucuccauaauaucuucgugaaccaguu

SEQ ID NO: 298 - RNA, 568 nt, Artificial Sequence
  Synthetic
cagauacugcccaaacuaccuucauaauuuuccgagcuacacaccagaaccucgaguauugacauuacggaaucaucucaccauuuaaaaguugcgguuuaacuuaagcuguagccgcaacaguuucagcugucccagcuaguccuucugauugaaguuuaucauuaguaaucccuuuagcgauggcgccauuaguaccuucgguugaguugccaacauuagauacuucgccagcaccaucagauacauguguaguuaauucuucagaggucuuguccggacuaucuauugcgaucuuuacugcaaucucacgaccuugaacuucuuuuccauucauuucggcaacagcccuauuuugaaguucauuagaugcuaaguucacaaagccaaacccacggccuuuccgagguucguugcgggccugaagcuuuuuaaccaugaauuuuggaauaggacgcagagcaauuuuggcagauacugguucguaaucggcaaauaguuccuuuaacuuuuccucggauaagucauaaggaagauuggcaaccauaacuuuugucuuagauggaac

SEQ ID NO: 299 - RNA, 598 nt, Artificial Sequence
  Synthetic
aaauguguaccaccuucuugauguaauucugaacgcagccaaaucucccaagucagauccaucgucagcccguccuccaaagacauacaucacaucgucaacaauugcugcagcaugaccuucucuuggaaccgguauauauccuaugcaguccaaaagaguccaggaguucgguaucggaucauaacaccaaacaucguuauaccauugaagaccauuuguuccgccaaacaaguaaagcuuuucauuauaugucacaacugagugauuuguucuagcugaugguauuuguccuacuggggguccaccauccucacuauuuuuaaugagaauuucccaccuguucguagggacuugcaaaagauucaaaucaaaagccacaaggucauucauaaaauaacccucuacuugccccccgaauacguagauuuuagacccuaguauauugagagaaugaccauaacgccccgcgggccguggcccggcagguauagcucuggaccauugucggguagagguauuaaguaaguaaagaguuucaucuaauacgucagaaucguccauuuuaguauccccaccauauacaauaaaagcauuu

SEQ ID NO: 300 - RNA, 598 nt, Artificial Sequence
  Synthetic
guagcgaggauggacacuggagaacgguucgaaguauacuugacaaauuacgaaaagcugggcuauaucucgauauugauaaaugugaguuuuuauguaaagaagucaaauauuugggguuuauugugaaagcugguaaaaguguggccguugaucaaucgaaggugaaggccauucuggagugggaagcgccaacuacgguuagagggguaagaucauuucucggauucgccaacuucuaucggugcuuuauuaagggauuuuccgacauuacaucaccccuaguugcccugacgaaaaaaaagguggaauggcgaugggggcgugacgaaaaugaugcguuugaaaggcucaaagaaauauucucaucacagccuguuuuagcacagugggauccagagaaggaaacaauuuuggaagcugauaguucuggcuuugcaauuggugguugucucucacagguggaugaacacggccaaauaagaccuguggcuuauuucucgaagaaguuaaauagugccgaagcuaauuacccaauccaugacaaagaauuacacgcaauagucacgugcuuaaaagaauggaaaccagagcuaau

SEQ ID NO: 301 - RNA, 580 nt, Artificial Sequence
  Synthetic
cugaccggggcgcuauuacgauuaaaugagcuguuuuccccagcgcuauaagcauccagggagaauaagguuacaaaauauaauccgaaaaaagauaaaaaaguauuuaucaauuguuucaaaucgaauggcuuagacaacuguguacucggacucuuaguacucccuagaguucguccuucugagguauaugauagaccuucuaggccugcaagucugaugacagacucgauagcaguucuuaaaguagacugaucagcgccacggaucguauuggcaauagagccagaucgaaagauaaugaagcugggaagugcucuaacuccauaacgcugagaaauauccuggugauugucuacauugaccuugacaaaggugauccuguucgguuucgaguauuuggaagcaagacuuucgaaggugggagcaauagcauuacaugggccgcaccagucggcauaaacuaacccagccauuaguagauuuaguuaaucggugacgacuacuuuugaagaguucaaaauuuugucaaacugagaugaggaucugauacggauagacaugcuuucuuucuguucaa

SEQ ID NO: 302 - RNA, 594 nt, Artificial Sequence
  Synthetic
aaaguuaucgccgaagucgcagaauauauauccaaauaauccaaagguuucaguuauuacuacauauauucccuucucauguagauacugggagauuaugagcuggucuuucaguggaauaucugucaauauuacagcuugauaugaaucaaacugggagagaucagaaacuaagcuuguggagcugugaaucuuaacagggguguaagcauuuaguuccgaaacucguugagcugagacaauaucucuagguuuuccuauaucuucuggguuaagaaagaauugagaugauaggucagcgauaguugcgggagcgggaucguauaauguuagacuuuuaacuccagccagagcuauauucuuagcuauuucgauaccaagaccuuucaagccaauaauaagaauauucgaugcacucauucguuucauagccucguguccaagaacguagaguugccuacuguauaaagacucaucgauaacauuauuauuuucuugugacucaucaacuuccaucuucaucuugucuucaauuuuacugacuucacucaucuugaauacuuccuguaaauccaauuuacaucaacugaauua

SEQ ID NO: 303 - RNA, 580 nt, Artificial Sequence
  Synthetic
uugacucuaguuuuaaauacacauaaauguuugcucaaacuaucuagagauuuugcgucuuguaaaaaaauacuauauaugaaauauuauuguguacuauugauguaugaacucgaugugagguuuaaaaucuuauugcugccauagauaaucaaaaaauuauauuaauccuauccuuuuggaacgauuccuaauagcagauguguguucgucucuguccuuugaaugacucauuucaguccaaaucuucguugcuaauucauccacucauuucauagcauauuuuuuugucgcuuuaaccgccucuucauuaaauucauuccuguuauuccuguaucuaucugcuaaugccguuucuaccgcaucaucaaguaccggcucggucagcauuugcugcguugccaucaaaauauugaugauucgagaugaugguuuccaggcaucugguuugagagcaccaauacacauacuacccugcucaucaaaagucacauuuggaugguagauacgaguuuugaacgauaguuuugguggcuuaaaaggauagucugaggggagcguuaaaagaaguucaaaguua

SEQ ID NO: 304 - RNA, 527 nt, Artificial Sequence
  Synthetic
uuccaaaaaaaaaacucaucagguuuuuagaacacaaucaaacguuuggcccuuaauaguaccgccagccauacuauuucuaacauuucucuugaauaucucacgaugauuccgaagaucuucggcggcuucuuuauucaacggauccgaagaauuuggcucuaaaaagagaaaaauaauuaaagaauuccaguagcgaacuagaccagaguagagcaggaaggaguauucgaugauaccuaaaaaaagacacacacguuauaaaauggcucuaagaaugguauugaggcuaauguauauuuuuuucuuugaaaaaacaaaaaacaaacaaacaaaaaaauuauggauaauaaguaauccuaccacuacacucuguagauuuaggaccgguuuccaguccucacgcaagauauugagacacacguuuccaucaagaucgauauuuggaugauaaaucuuuucuauacauuuuacuuuuggcgcuucaugagggaaguuuugagagauagaaaaagugaauugaaaac

SEQ ID NO: 305 - RNA, 560 nt, Artificial Sequence
  Synthetic
ucgucauccucgucuuguucaaaaucauaguuaucaucgucugagcucucgcugguaccgaacucauccugaucaucacucucguuccagaaaucaucgucaucauuaauuugcggaggaggcgccucaauuaauguuuuuggcaucacaaaacccuccgguauaucucucauagaaauucuuacugucuccaaagcccgcuguuuguaagccuccagguuaucccgauacauaacgcuggcaucaacauuugcaggggagguaaucucagggucaucuaguaagagaagaauagagcggagaacacuuucaacacucugaauugaugaccagcgcucacaagcaagcucuccagauuguucaucaucuccagcagcguguaguauugagaugcaaacccugccaucaggauauauauuuggaugguaaauagguugcaagaauuugaaggucggaggagcauaaggauauuuaucaguaaaacccauuucagccuuaaaauaagccccaucgaaagcacuuucuggguugacuacuauuagagcgauuaaccacuugaa

SEQ ID NO: 306 - RNA, 586 nt, Artificial Sequence
  Synthetic
aaaaucuaggcaaauccuugaaaaacucagagcuuuuuuuuucaauaaaauucaagucaaaaaaauucagaucuuuucgauuuucaggaauaaucaauuuauuucugcgauuuaucgcuugauuuaaaaauauacuaggcacccaaaaaucuugacuucucacauuuucugucccaaggacaauaguuugcugaauuaauuguagaucuguauauaucuguugacucauuuucugaagccagaauucaucuuucgguauaacaacgccauuaaugauaacugggggaacaaggucaucugcacaaauccugucuacccauuuuugggacgauugaauucgacucucgagcucaucugauuucaaaacuucgucgaaaauuauucggguuuuauuagucuuaauuuuugcuuucugggugauuuggucgaauacauccuuacuguuuaagcuaagcuuugauucauuuugugaccguaaauaugcuauugcaguuuguaauccauaaauuucaauaaggugauaaauuacuuuugcuucgauugcagcauuugaguuucugaugacgggaaugagaccaauucggau

SEQ ID NO: 307 - RNA, 595 nt, Artificial Sequence
  Synthetic
cuugccaucucuuccaaccuuucucuuaccaucaaacuuuguuccuuuuacugugauccucucgacaaguuuuccgcucaauguaucccagacaaccacuucaccaucuuguccuucaauauucucguuuccagaaaguauccaucucucucuuccaccaaaacaguuccauauucgaaauucuuuguuuucccagcaaucugcacgauaacuccuuaguaauuuaccauucucgguauccauuagucuaagcugacuauccaguccaccuacaaguagaccuuuuuuaucuauugucuuccuuagacaugucacaggagcaccaauaacaucgacaacaauuugucccauucuaaugucguauuuccuaacuuuuccaucgacacuacugguccauaucucgcuaucacucgcuaauacgcagcucacacuaucaccagccucuguuagaaccauaacuggcuuagcacucgagcucuucacaucccagauacgagcacuggcaucaaaaccuccacuaauaagaagacuggcuccauccccagcaaaaguaacgguauugaugcgugccgaaugaccauuguugccacuaaau

SEQ ID NO: 308 - RNA, 590 nt, Artificial Sequence
  Synthetic
uuucaguacgugugcuugccaauagaucguuuuugguuggucaauagaaaaucaccuugauggacugaauuuugagauucgguaaagauucgccguagcaggacagcauugauuggcaggaacccaauuuuuggacgcucagggacuggaaucccgaugguuaccgggcuucucucgcauugccucuucgugaagcaagcugagaaguugggagaaaaaaaaaagggagauucuagcucuucgggacuguaauuuucauucguugacguuuccuuggucuacguucccaaucaacugacucauauugaaaaauaguuugaggcacagaaagaauuacuagacacaauggcuccaauugcgacagcugacuugcguucuucaagugauccaaaugucaaagaaucaagugacgagcagucaaaaucaaacaucagacaauuacccgugacacuuuuaucuggauuucugggaaguggaaagacaacucuucucgagcauaucuugcgcucuaaugaacauggccuucgaauugccgugauugugaaugacaugucaagucuuaacauugaugcuucucugauccaacaaca

SEQ ID NO: 309 - RNA, 556 nt, Artificial Sequence
  Synthetic
uucucuuagggacgguuggcaucauuauuaauuuugcagaaccaauuccaucucgaucuuuuccgauuuauucucaaaauggagauauuguuuauccucaauuugcauauccucuucgcaagaauaucauuccaauuuggguagcaauuuuguuggcuucacuuauuccuuugcucaucauuuuccuuacacaauuucguauucgcucguuuugggaugcaaacaacgcgauuacagggcuauuauacucccuuauuaucgccggaguguuucaagucuucuuaaagugguuaauuggagggcugagaccucauuuucuaaccgucugugagccaauaauuccaacacgugcuccaauaaaggcuagauaugggccuagaauaauaauguacgacagaaaugucugcacuggcgacaaaaggcagaucaauaauucucuugaaucauucccuucaagccaaucgacuguagcauuuucugguuucguuuauuuggcuauauaccugaaugcaaaacuuaaaauuuggucuaauuaccauucugccauguggaagau

SEQ ID NO: 310 - RNA, 545 nt, Artificial Sequence
  Synthetic
uccgcauugauggagguuucagcuauagaauugcauucuaauucuagaucugcaaguugcuuugaaauuuucacuuguuccccaaguaaauguuuacgccaaacgucugcauccaaaacagcuugaagcgcaggaguaucaucuccucuuaucuccuguucaacgugaaguauugaaauaugaguaggaauagcuaguucucuucgggcaagugcacguaacaaaguagauuuuccaauaccauucugaccgacgagaccauaccuucgaccguacgcuaagcuuaaauugguaucuguaaguauucuuaagccgccaauagauacaucaauuccaucaaguuuuauaucuuugcacuuuugcuggccuuuuaacgauccaaguugaaggggauugacggccaugaaaaauucuucguaugacugcguauuaucugcuugauuaagaagccgugaagcuucguacugaacuguuuuaaaaaccuuuuugcucuguuuagcggcaauuuuucguuccgcuuuuucuaguuuuuugcgaucaacuuu

SEQ ID NO: 311 - RNA, 556 nt, Artificial Sequence
  Synthetic
cggacuucuuggucaggcgcaaaagaaguugaaaauaccuuuccaacuuccaaaucucuggacacuaucauugaggggcccgauggcugaauauuccacaguuuuacgaguuuaucagaagacccuguggccauaaacccgggaaugauaggauuaauaucaaaagcacaaacugauuugucaugugcuugcaauaaccaaacuggcuuacuagaacugggaguagauggugccauucguauaucgugauaauggaccauaccaccuucugucguuacguaaaagaaauuuggguugugugcaucccauuugacagcuucuacaucacuuucuacaccccaaaucggcacuuuggauucuggugcucucaugucggccgcuacgacacuccgaucauaacuuccacuaaguaagacaguggagucaacaggaugccauuguauugagcaaacuuuaucugaaugauuacuauaugauuuagcacauuuauuaguauuaaggucccauaguuugacagucuugucggcggaagaagaggcaaguaaauuuugguguu

SEQ ID NO: 312 - RNA, 477 nt, Artificial Sequence
  Synthetic
uccccgaauuuuuggcauccuuaaccgaagacaccaaauuaugaucggcuucgccucgaaacaguugcauuauuucaugcaugcccaacuugcuaauaccauuguuuuuaccgccuucgaucguuuguugagcuaacucacgcuuuuuuucuugcagcgugagaauacguuccucaacacuauuagcaaugguaauuuuauaaacgauuacaucaguuuuuugaguaagacgauguacacggucaauugcuuguuccucuaugaauggauuccagaaagguucgaggauaacaacgcggguagcagcuguuagauuuaauccgagggauccgcauuuuaaacugcauaauaguacacggcaagaauuaucauuucguaagcuguugagacuagcuucacgcaaaucauuucucauuuuuccaucauaucgagugaauuugaagucauucuuuagcaaaaaugacucaaugaggucaa

SEQ ID NO: 313 - RNA, 595 nt, Artificial Sequence
  Synthetic
ucucuucgcgaccgauauccauuuccugaggguaacagagaaugaucuucagcacugucuggguuguaucugccaguucccucaacaucugggucgucccucaauaagcuauguaaguccucuucagcguagucuaaauuccuuggggccccauuucuucuuccuaacccucugaauccgcucaugcguagauuucucaacggaauauugcuuucaguucuccagucaugcgcuuucgguuugaucccuuguucaagcuccuggauaucuaaauccagaucggaguccgaaucagcuugagguggaauuugaucgcccugaugauaauaugagcccgaagacaugccucauuguauuuuaucguuugaucucuauaaucuccuaggugauguuauaaagcuugaccgcauaaaaucgguuaaucauuuaagcaaaugcaguugcggugugucauaucuuucacggcagcaucuaguaugucuaguauggcugcuacuguauuuuaaauaaaccaaaacauguucaacacauuucauaagguauaagaaggauugugaauauaauuuacugguaaauuuuaaaucauaguugaaaa

SEQ ID NO: 314 - RNA, 539 nt, Artificial Sequence
  Synthetic
aggaucuucuuuugcucugcauuucaacucgaauaaccucaauugguugauuccacgcacucaacccucccccaagggcacuagcgagaauucguucccaagcacuuaauggaccgccauuuucuuuuccugaaaccuuucggauucccuguucugccaaacgacuuaauccaaaucuggauccccaauucgucauuugucgaauggcaacagcauucacaccuuuauuaauaccucugaucccaucuuuacgguauauauccauaaauguugagaaaguuccugggggcuuuacaccaguggaugcuaauuuggauuucguaaucuccacaguuuucaugcauguacaaaagcccauaguggcauaugcuugagccauacccccgacaacgccuccugugaugccggcugugaagaugccggcuccaaaacuucgagcauagaauucugcuucugaagcgacaaauagaagaacugcaccuuuugaugaagcuucaauccaagcccaugggaucaagcccugauaaaaacccaaaaca

SEQ ID NO: 315 - RNA, 598 nt, Artificial Sequence
  Synthetic
uucucuaacgucggaaguaguaguuuugugaguagaaaaugcccuauaugguuuguaccgaacugaaucucauauccuugcuuugauuuucccgcgggugucaccauaauuccugcauucaaaaacaagagaucuaaucucuuuucucuguuaagaaauucccgugcacacgauuucacagauucgaggucugcuaagucgcaggguagguaugagacuuuagcugauggaacugcacuuuugauacuugccagggccuuaucagcaguagucugauuacgaccugagauguagauaugcgcaggauuuuuucuagcuagagcaagagccgucugguauccaauaccucuagucccuccuguaaugaaaauuacuuucucugacugaucugggauauccuucucuugcgagaaagagaccccaccgaauaacaguccguagagcauucucguucucuuacuguaaaucaauuaaaucuauuuccugugaugcgugauucagugcgaaaggugagaaaaaaucaagagcagcuagcggcuuaaauacuccucuugcaagcagaucaugcaugccaauaagaauauucaaggauucaugu

SEQ ID NO: 316 - RNA, 596 nt, Artificial Sequence
  Synthetic
cuggugcccuuaacuugaugguaagauuauucggcagaguuuuuaccauuugaauauuugguauugauuuauauccuugagccucauuuauuugcuggauagcccaagccuuaaacgcagaucuuucuuuucuaggcguauucucaauuucaucgcaaucaucagaacuuucauucucaucacggcuacuuucuuuacugcuaucugacucguaaucagauaaauuugguccaauuuuaucuccaacgucuucugaggaauuugucauguuuccuaugguaucacgcuggauugacauacuugaaucugaguuuauaccuucccauucugauucaucaucggugacaggcuugcgaauaucaagagaaaauuuagauacaaugccgccucgucguuuucuuuuccccagaauaggaauucccuccuuacuuauuucgaguggcuuuuuuuaauccagcucccacaguuauaucuguuugcuucugaguaguaaguacugaagcuuuagaggucucaucgauauuaucgucacauggagauauucucagaucaucauugguuacaguacucucaucggaauugaauugauuuucguu

SEQ ID NO: 317 - RNA, 481 nt, Artificial Sequence
  Synthetic
cgcguucauaaaauauaucuucauaaucagcguauuuaggugaaaguguaguagccaauguccacauggcauagcauagacaaauuggaggacgggucugaauuggacguuccaaagacauguaaaaccgggcuugauguaugaugggcauugaagggugauagagagugaaguagauaugauauaauucuuuaaucauauaaucaggcgguaaugguucuugaagaccuaagcuuaguagcucuuuauugauauuugauguaguuucuuuaggcaucugggagaagccugaaauagguggcgacguuucaauggauguaagaagaggccuaccaucaauugccaaauucaaaucuauacccauauuccaauuucuuucgagccggggagcugcagcaucgggacuuaugauaucgcauuuuccuuccgaguugagucgagucuccaauugagcuagccuagcuucaauuucuuuuucuuu

SEQ ID NO: 318 - RNA, 598 nt, Artificial Sequence
  Synthetic
uacccaucccuggcuuaaguauugauuuauacauucuaaaagagaguucgacgcauauuaugaucuacauacggaaguuugguaggaugacgaaaacuccuaacuuuuaaauugaaaauucaccaaucugacaacauaucuaucuuauuauuguugcccuaaucacugccuuuaaugaaggaauaaaaaauuaaaagaugcccgucacugacuaacgcuuuuuuuuuaauuagccaaauuaucaguuaacugcaaaccagcuacagcgagacgguuuaagcucccauauuuacaaaaacugacuugauuugaguguaaccagcuagaccagcuucuccuagcucccguccaauuccacucuguuuuacaccaccaaaugggaccuuaaaacuugaaucauuacuugaauuaauccauaccaugccugauucaauuuuucgcgcuacccgaugagcccucguaauauccuugguaaauacugcacuaccaaggccauagguaguaucauuugcuaucuuuagggcuucuucuucuguuuuaaagcuauuuaugacaacaaaagggccgaagacuucuucacgaaauauuuucauagaug

SEQ ID NO: 319 - RNA, 554 nt, Artificial Sequence
  Synthetic
uaacacccgcaguugccaucagaaagaagggaguaucuuuaacuugauucucagguacaauacucaaugcaugaucuaguaagcuuugaagauguucaggaccaauaucuguuaugcgaucggcaaaggaagagacgccggguuugauuuuuuuugaauauccagguuuaguguguaacugagguaguugguucaauugaaucucauuuuuugcaucguaacgagcucgagauguauugagccaccgguagacguggacucgagucccugacgagcccgcgucuaagauaaccccccaucgccauuuacccauaaguagccuaucguuacgguuuggcgaugccggucuaggauaugugcuucaauaucaaaaauaauccgugaagcguuacaaaaacaugagucaauuauacggaauuugaaacgagugugaaaggaagucggcagacucaaaaauaaaaaagaaagauaauaauucgaauuugaaugagaaugaguaguggucggauaagauguuuaaugcuaagugcuaagauaacugacuaagacuugau

SEQ ID NO: 320 - RNA, 456 nt, Artificial Sequence
  Synthetic
uacggaucgauagacgggugagugaaagaugaagugcaggauuuuucucuauaaguuucuuacguuguagcgccgaagcuucucuaaguuuaaucucugauggagauaaaacguuauauauaggcguaccaacagcaauuguccccucuuuaaguagauauaacuuucgcuuaucuuugucucggucagugcggaaguuugucccagcuucuguaaguuuuacagcuuuuucucgauuaacugcucuugacacuugaaguacgcgaccuucuauuguguauaagccauucuuaucagcaguuucauccucuaaaauagaguuuuuagcuuuaacagcguuugcaccacuuuugaagguacgaggugcaccaugguaacaagaguccgcaucuucuugucuauagaagcaaacaaagccagugccuuuaggucgaccaguauuauugucuaugacca

SEQ ID NO: 321 - RNA, 553 nt, Artificial Sequence
  Synthetic
gaccauuguggucuuucgacaaaaugauuucaaacagcccucgugugcacauuuguauggucuuuuuccuguaugaauacgacgaugacgagccagacuagaugaaucagagaaucguuucccacaaccaagaugcuggcauugauguggcuuuucgccaguguguguucgaaugugcacaguuaaggcacuucuuugaaugaaacuuuuuccacauccaggcugcaugcaugaauauggccguucguugguauguauucgauaguggcguugaaggucagacuuccuguugaaacucuugugacaugucugccaaucacacugaaauggucucgcauuagguucguuuucaacgagcuccauuacauccauagugaaccgacaaguagugucgaauguaugcaaugucggagaaguuaaggguuggacaagagguaccgcagcaaaagcugcagguguggugauuagguggggaugggugucgaauauauaagauugcgauucucuauuuaaagaaaaaagaaauauaagcaaaauaaaauauuucuuuuga

SEQ ID NO: 322 - RNA, 497 nt, Artificial Sequence
  Synthetic
caugagcucguggaugacgaagaguguuguccagccaucagaagggcuaucaucauaugcgcuaucucucgaucagguaccggagucccgucuuuauaaguggaacgcaucaacucccacauuauaucaugcuuauucucaccgcuucuuuucucuucucuacgagcuuggauuauauucauauaaguccuagcaacaguucuuugggcaugaucacgagcacgauuccaagguagaggugcccaguaaaauguaaaguugaucgguguaaaucccauaucaagaucaugauaaagagcggcaaaagaugagucaaaauucucacggaccucuucuccuuguaaggcaugugaagcaguauauauagugauuuccgccauaacuuuugagauguuuacugugccacucucacccugaaagcuaacgcaauuguuuauauaugccucuacuucauuuuguauuauuguuacauaggaauggaacgcuucaugguaaga

SEQ ID NO: 323 - RNA, 449 nt, Artificial Sequence
  Synthetic
gacugucagucacaccugcaugguauugauuaagaaugggguaauacaauuugaaucuguucauaaaaugaugaaccaacuuacaauccuauuugaugauccgaauaggguucggguacacaacagcuagacuccacgccaacagcaaaaaaacaaacuauuuucgucuuggaucguagaaauucgacgugaugcagucauugccggauacgaaagcucucgggaacuucgaaauauugucuuuuucaacuguugcagacggguagccaccggugcccgauggagaugaauagccgccaguuccaguugcagacggauaaccgcucguagcaguuggcgauagaaagccaccuguaccagaugaagguggauacacacuuccaucaccauucgaugguuggccauaguagccaccaccuuccugucggcuucguagaugccaaggugag

SEQ ID NO: 324 - RNA, 460 nt, Artificial Sequence
  Synthetic
uaucaauacgcagugcgagauuguggauguugucacaaauaacgaagauuuucacuaccaacagugcacaagggguuggcauugauauuuuagauccaaaaauuaaggcuugugcucuuauuuuaauuaggaauugcaaguaaaaguuaucacucuucaaaaggaauugaguuaaagcugugaaaaaaugaccauuucaguuaacuauauggaauuaaguuugcauuauguuugacauguauauauuuuaauauaguccugcucauaaaaaugcugcucauguuuugagcucccacaguaauauccaugaacaguuuuacgauuagaucucuuacuaaucccauaaccaucggauucaaagccuauagaagguacauaaccguuaauugcauguugcgaagugaaaugaugauccgaguagagaucgguaucugauuggguuuucuggcgguucuuccaa

SEQ ID NO: 325 - RNA, 481 nt, Artificial Sequence
  Synthetic
uucuuuuucaucaucaucaucaacuucaucuucaucuuuuucgcucaguuucuugcaugugcgguaugaaccauugcuuuuccggaucacagcaccgacaacuuugcaguuuucgguuaggaugaugcgguaacggccucuucucaaauuauuccaaaaucuuccauugcgcuugauuggccauucuagauaaggcccgggaguuucgaaaucgguugcgguguaaagagcaggaaaggcauugcgcugcuuguuuucuuugaucuuugcgcaggcuacggcuuuugcuuuuucuaccgccgccagacugaaauguuucuucuuacauuggaagccugaugcguguuuagauuuuuuauugcauccucgucuaaaacaaagucuuuucucgagacuuggggaggacgcugaagacaagucgaaaucugcaaccccagguagcccugacaguguagggccgucggcgauguccgcugcuacu

SEQ ID NO: 326 - RNA, 475 nt, Artificial Sequence
  Synthetic
ccaccuugcagcuuuuggucaugaugauacgguacuugcccuuacucaauuuguuccaaaaccuuccauugcggcugaucggccauucuagguaaggaccuggaacagcaaagucggaugcaguguagagagaaggaaaagcggaucgcugcuuauuuuuuuugauuuccggacagccagcggcuuuugcucucucaauuuucuccgagcugauguacuucuuuuugcauuggaaaccugauguccucuugagcuuuucuuccuugcauccucgucugaaacaaaaucuuuucucuaggccuugauaugacguugaagaccagucgaaaucugcaacguucgaaacaucuucuaguauagaaucauuuaugauaugcgcugcagcuucgguagagucauuacuagccgccauagaaagcacugaaauuggcgacaaaaugagugaagagacgacagcuccuaugaugaaacgcau

SEQ ID NO: 327 - RNA, 490 nt, Artificial Sequence
  Synthetic
gagcuucaaguggaagccgagugagaaaugaaagcucgcagaucacugucucuaaugacgcauuuuuuccgcggugauguccagcccauugagguugaguuuggcaauucuuaucggggucaucacaacggaaaaggaugucuuuucggucagaagaagcaauuuugucauaccaucccaggaccgauccuguaggaccuugaccgaaauauuucuuauauaugggugauucaguucccuucacaagaauauguucuuuagcaugccuagcaagugucacagcgucagagaggccgucuugcagcuguuuuuucuguguugcauugcaggaaucaugaaguucgaauucgcuuguaaagccagcuuuccaaucauaggauauuaagaacggauuauuuuggucgcucggaagaugauuaucaccaauauaaagaggauucgaaaguaccauuaaggccuggcuugagaggaaaauaaauuuuuugaacau

SEQ ID NO: 328 - RNA, 226 nt, Artificial Sequence
  Synthetic
guacggcgaaaugagcaugguaccaugaacuuccguacugagaggcaacccaucuauauguaaaacuaucaccgggagcuaugggacacuguguuauugauguuggaccauccauuugguuuguuucgaauugccggaguccaugaaaaugaaugcucguuccauuauucauuaaugaauuaguaacauguacuacaacaguaucaccccaauuggcgauaaucgu

SEQ ID NO: 329 - RNA, 590 nt, Artificial Sequence
  Synthetic
aaaagaugauagcuauaacuucaaguuaaacaucuuuuugaaaaaaugcgaauuagcgagcaucgaaaaugaaaaagacauccugucuucuauguucuuaauguuuaacaaagaagcauuagacuucuaccaucaucgcuguagcaaugcaauacagaucgaugaaaucucucaauuaaugcuuggccaauuugaaggaccacaaaaacagagaaaugcacagaaugaauggaacaaaauuaccuugcaacuucuuucuagucaacauucugaaaagccauugcuugauguauuugaaauauuaguaaaacaacuucguaaucuccaguuaugcuugcgaccaaauuuucaagacgaaacaacccuucgugacaaaauuuuacaaucuguuucaaauauacccgaaugucgcccagcuuguuuaaugccugagcaaucacucaauacuguuauuaauaacauuagaggugccauuggaaugaccacuagcuaugaaccaaaaccugacgaaacauuguuugucaaucggagauuccauaucaaagacaaaaguaauggguuucguaauaaacagucucaaaacaauucag

SEQ ID NO: 330 - RNA, 577 nt, Artificial Sequence
  Synthetic
ucauguuaucgaaacguuugacaaaacgucuuuugaauuucuuucgagccucgucuugcucugauuuugagugguauuuugaauggcaauuugguuuuucgcacacauaacaucuucguuuugauguagacugguaauuagacuuguguuuguuuugauugauacuuugagaguuaaugugguauuuucuaucuguaaagaauugugaugauugaucuuugauauucucaucgcuaauagcaauugacgauugaaggucgcuaaugaggccugucaauguauugcuagguuugaaacaugcuaguugacaugcagauauauugcggcaggaguugauuaguuuuguaugaaggacuuuuucuguucggaacucuuuaucuagacuaaguugaagguaucuuaguucauucaauaauaguguaaaacaaucguccauggacuuuucuuuuccuugguuuucaucgauuaucuuuuguaaagugggugacucccaucuagcaguucuucuacgucugauuucaggccccucaaaaugaucucuuguagcauuaacuaaugucucaaagucacgccggaa

SEQ ID NO: 331 - RNA, 597 nt, Artificial Sequence
  Synthetic
uauucguauucgguccguuucgaugguuuagagcacuauucacgguuagcuuugcgcguaauuuacuuaucucuagcaucgccuuuuugauugcagcagcccguugaauuauggauggcauaggagggucuaaauuugacauucuuggauaagcuccaaaaacuaaaagaguugggacuaagccauuagguccggcugugucguuuauggcuuuuaccgccaucuggagcauaaacucuuugccgauuccgguuccagcuaguucuucugauauaauuuuauaagcucgacgaaugcaagagugauagcgcucuauuuuuccuauugaccaaugcgcuucaacaggaacguuuuucaccgaaauuuccauugaugaugcauuuugauuaaauuccuugcuaacgaaguuuuuaccagcaucuguuauuaugcagucugggggcccaacguaaguaucaauccaacaagcacguauggcaucccauguauguuuggcagagauauuauugagccaccuagccgccugaaaauuaguugcuucaucaaugauaugcaacacuagauuauuaucaauauacauuaugucuauaaguauug

SEQ ID NO: 332 - RNA, 565 nt, Artificial Sequence
  Synthetic
auauauugcaagcuuaugucagccugaagcuuccuucgaucuuuccucugcugcccaaaaugucaauccaaacgaagcagauaucaaauuacuuaauaaaagaauuaacuggcaaauugagaacgcuucuagaggauugaaauucguuaaacucaauaaaaacucauuaagaguaauaguuuuugcagauucauccuucgcaaauaacaaagacuucucaucucaaauugguuuuguaauuguacuagcagacgaggagaaucgagcaaauauucuccauugguccucaauuaaaugcaaaagaauaacuagaagcguccucgcugcugaacuuuaugcaauggugcacgguuuugacucuggagcaaccauaaaaucgacacuugagaaaauauuuaguaugcgaauaccucucauuguuuguacagacucuaaaucacuauaugaaugcuuggugaagcucggaaccaccagagaaaaaagauuaaugauagauuugaugugccuccgccaaucauaugagagacgugaaauuacucauauaugcuggaucaaaggggauugu

SEQ ID NO: 333 - skipped

SEQ ID NO: 334 - RNA, 484 nt, Artificial Sequence
  Synthetic
aaauauugugcaaaaaucuaaauuguguaccaucugaugugacgcucaucgcucgaacccccacuggcuucgcacuuacuaucaaagaaaaggagauaaggcaaaagcuacuaaaugacagugauagaauaucuuuucagggugccaagcuagaaccggcgucugaucuuauuacauaucguauugcaacuguucccguugcccgucaaacuucuaguggaagugugacagucgacgauacuaaccuuguagccgaaauuaucaaagucacuaacuuugcgccuaagaugguuaggguacaugguaagacucguucuggugcuccacaucgcucuuggcuggcacauuuuucccgagaacaagcuccaugacccggauuccgacuauucgacgaaucaggagucgcuauacuguacaaaccaugccaaccaauacaacaaugcaaacguugucauggguuucaugcuacacguggcugcucuag

SEQ ID NO: 335 - RNA, 588 nt, Artificial Sequence
  Synthetic
ucuuuuuuggauaguguuaucaagucuucuaucagcauagacucgaguuuucacgccaggugauacugcuagcccuaacauaucugcaaauucacuugaacaacauacugaagacuuccgacuuaagccccgaauagcauugagagaaagcuuaggugguugugauuuagauggucgucguuuuuuugaaaauaacuuuugcguaaguggccugagaguugcaauauuugcagcugucaaggcaauggcugguucuaguaaagaccauuuuauuaauccaaaaccaucccaaccggauugugacacauucuuaagaauauggagguaaauaauacguauaacaguagcuauagaggcuacuauacuuaaugaaagaacgaucauuauagagagcuuggucuugaacuucaugucgaguuuccagagaauuaaaaucgguaauaucccaaagauccagucaauuaaacaacuuauagaugcaugagcauauauaauaucggcuauacucuccuugcucaaacagcuuccagaauauaauuuugaaucaaguuguugccaaagguaguuugcaggucgacauugaaaagc

SEQ ID NO: 336 - RNA, 403 nt, Artificial Sequence
  Synthetic
ccacaauuucuacacuuaguugcggccauacauaaauccucgguaugauuggucgagccacaauuuccgcacgaaggagcccuugagcaauuuuuaauagaguggugcccauugcaucuuuuacaaaauucgagagguugcugcuuuuuaaaagaccucgcucgcaauuccagauucgucgaacacuuuaaaagugccgcguggagcuuucgggaagaaagccauccauguucgauacggugccucagguuuauuucuuccauaaagcuuuaugugagcuggccgcacagagcagacacguuccaccucaucagcaagcaugcuguugcucacuucaacuacuccuuguucuuuauguaaaacagcuggaacuguugguauuaguacugacacccaguuggug

SEQ ID NO: 337 - RNA, 383 nt, Artificial Sequence
  Synthetic
uuaauuuucccaaccaauguacaauuaccucacguauucccaaccaauacgggugagauugaaaguuucuuuaaaauuaccuuacguauuucagcaggagaaagcuuucgccauucauguucuugggggagacggagaaacagccuauuaucugucggagcagcugaggcucucuccacaauugauacucguggucuuauuuuacucaucggggugguguguauauuauuauuuugaagaacucgggccuucuucugaccauuucgagccacaguaacccauguguucagugagguuuggggagguuuugguaauuuagggguugcaacagcaacauucuuuucuacauuuuucccuuuuccagacccagagccacuaccuuu

SEQ ID NO: 338 - RNA, 392 nt, Artificial Sequence
  Synthetic
agaauaugagucggcauuugauuuugcugcugcaguugaugaggcgaaaugcuaggcaaugaacuauaauucgcuguacugcuauucauauuguuugagugaaacuggguauccauaugaagagaauugggcauacuagguucaaaggcuuucuaaucguuagauguaaaccaacuccuuuauccuuuuccgagauaauugguugguugaauaauuaagauucccuuguaaauauuaacagaguauuuauuauggauuuuaauuaaauuuuuucuuuuucuuuuuuuuuaaauuuuuuuuuauuuaaauuuuccuuauugaauuauugucccacgcaauggucguaggauugauuauuugguggaaaaauuaaggacagacccaagguugug

SEQ ID NO: 339 - RNA, 371 nt, Artificial Sequence
  Synthetic
uauaucauauuuuuaauaauuuuugguaauucuauuucuuugaucguacccagauuuggauuuugauuacuguggcccaugauaauucgauuacaagcaauacgagguauugcgacugcuaucuuugacaaguuuuucucuuuacuuuucccuuuacugcuaucauuuccguuaccuuuauucggucuuguauguaaugggacacgagguggaggaggggacgaaucuacugcugcaaaguuugcuauugcaaguuugagguacgcuuugaaagcuacagccucuucuaucucuacuucuuuuguaaaagucgcuaauguacuaucuaugcuacuaaucaccgugcauugugcauaucauuagccgcgcgu

SEQ ID NO: 340 - RNA, 521 nt, Artificial Sequence
  Synthetic
ucaguccauguugccuguguuccuuguuuucuaccuucgcauacuuuugauguauuagaauaaacucgcucuccgcgcauagcucgggaggcuccguccgcuagaagcgcuaagaagucugccccaacuccugggugaugugcuucaagauuuuuuaaguaaucauuugucaagucuaguaggccuuugauugcauccaugagacuagccgcauugugauuaucuuucacguccuguccaugugcuaaguuaagugugguagcuaccgcaguaucuggcgcuauugauggcguggggaguucuucugcaaagggauccgcauucgaccccucgcugauaucaucaccuauauuaauuuccaugcuagagucuuuaucuagguauuuaucggaagagccaugcaugucacugagcgcuuucucgaaaacaacaucuuuucguaggacguugagaguaggugauagcaggugggcuuucgccguuauauugcgugaugcuuuaccugucguagauuucgguuu

SEQ ID NO: 341 - RNA, 598 nt, Artificial Sequence
  Synthetic
uagaggucaaaaauaaaucagacaacagacuauucauucgucuuccccuagaucaugaauggcguaaacucucuccugcaggccuucgagagguaauagucaaacauuugucggucuccccagcacuccugcgggcuuucgagaggugguacucaaacguuugucggucuccccagccucuauaggucucauuaagccagugugaucaggguuugcauuaacuccaugcaacaugaaauuuagagaagaucuccggcgaucagggcuuguauaacuacaugcaacaugaaauauagugaagaccuucuuuccgcuuccggagggcuuuuuauguccggagcgucacuagagccuggccccuacuggauuucaguccuugugccuacaguuccaaaaaaaauuauuaccauagauggucagguugaaguaucuaaguuaaugcucaugaaugagauugagcggguaucaucuaaacguccagcacacguaaaauuauacgguacuacaaauccagaagcaccucacaggaccuggcuugcucuauucucggaagcuccucgcuguggauucagagucuucgaugaauccgggauaacga

SEQ ID NO: 342 - RNA, 598 nt, Artificial Sequence
  Synthetic
cuuguggguuauguaucugccggaacuguugaguauuuauauucacaugcugaugauaaauuuuacuuucuggagcugaauccaagauuacaaguggaacauccuaccacagaaaugguuaguggugucaauuugccugcugcacaauuacaaauugcaauggggcuuccucuacauagaauccgugauauacgauuguuguauggugucgacccucaaggaucaacagaaauugauuuugauuuugccaaagaauccucuucugaaacucagagaaggccaacaccaaaaggacauacaacagcuugucguaucacuucugaagauccuggagaaggcuuuaaaccaucaagcgguaugaugcaugaauuaaauuuccgaaguaguucgaaugucuggggauacuucucugucgguacagccggcgguauucauaguuucucagacagucaauuuggucauauuuuugcauauggagaaaauagaucagcuucgcgcaaacauauggugguugcccuaaaggaauuaaguauucgaggagacuuucgaacaacuguugaguauuugauaaaacuuuuagaaaccccagcauuugaag

SEQ ID NO: 343 - RNA, 549 nt, Artificial Sequence
  Synthetic
aaaauuuuaaggauuugcaguuuuaacuucgugcuaccaaggggagcucuguugcuaguacugaccaugaguuuuagcaaugggccaaaucaggaagaagacugcgacccgaggugccgagggagguguuaaguauguaugcgauguaugcucagcagacauuaccucgacaguucgaauuaggugugcugacccucacugucaugauuaugaucuuugugugcuaugcuucucaaauggcgaagcuucacacaaccacaacccaggaacccauccauaccgaguaauagagcaaaauucaguucccauauaugacagaaacuggggugcugaugaagaauuacuucuuuuggagggagccgaaauauauggcuuuggaucaugggcagauauagcagaccauauuggagguuaucgagacaaggacgaaguuaaggcgcauuaucagaaaguuuaucuggauaguccaaaguuuccccuaccuguuagagcuagucucaaggauacucagcuucuugaagaaauuccacgagaagaauuucaagcaag

SEQ ID NO: 344 - RNA, 576 nt, Artificial Sequence
  Synthetic
caaugucagacguaauaacguugcaaaguuguuauaucucuucacacuuggggaaagaacccacuuuggccagauagaaugccuuaaauuacuugcgucuccucguuucgccgacaaacgccuugguuacuuagggaccauguugcuuuuagacgaaaaucaagagguucuuaccuuaguuacaaacuccuuaaagaacgaucucaaucacucuaaucaauacauagucggacuagcccucuguacgcuaggcaacaucgcaucaaucgaaaugucaagagaucucuuuccagagauagaaaaucuccuuuccacagcaaacccauauauucguaagaaggcugcucuaugugcuaugcguauuugcaagaaagugccagaucuucaagagcauuucuucgaaaaagcagaaacacuuauuucagaucgaaaucauggaguucuccuuuguggcuugacacuugucacuagccuuugcgaggccgacauagaagcugaugaagaaggugaagagaauauaguagagaaguuuagaccacucacuggaagucuuguucagacgcucaaggcauuggc

SEQ ID NO: 345 - RNA, 595 nt, Artificial Sequence
  Synthetic
uguagcuuuagcaaaagcccuuuuuguuaagccaucuuuacuucuacuugaugauccgacugcgcacuuagacuuggaagcuuguguguggcuugaagaauaucuuaagaagugggaucgaagucuuguauuagugucucauucaauggacuuucuaaauggagucugcaccaauaugauugauaugcggcaaaaacaacuuacauauuaugguggaaauuaugauacauaccaaaagacccgcucugaguuagaagucaaccaaaugaaagcuuaucacaagcaacaagacgaaaucgcucauaucaaaaaauuuauugcaucugcugguacuuaugccaacuuagucagacaggcuaaaucacgacaaaaaauacuagacaagauggaagcagauggcuucauucaaaaaguugagccugaccguaucuuuacuuucagauuugcagacguggaaaaacuuccuccaccaguguuaucauuugacgauguuacuuuuucauacucuggugauccuaaagaugauuuauacagacauuuggaucuagguguugauauggacucucgaacagcuuugguagggccuaaugguguu

SEQ ID NO: 346 - RNA, 466 nt, Artificial Sequence
  Synthetic
auaaguauucaagauuuugcuauuguucauugaucaggauacacgaguuuucucugguccucggaacuuaacaucuucaccaugggcggucaacuuucuaagaugaugggaaagaucuuugguucgaaagaaaugaggcuucucaugcuaggacuugaugcugccgggaagacaacuaucuuguauaaacuaaaacuuaaccaagaugugacaacuauuccgaccguuggauucaacguugaaacagucacguacaagaacguuaaguuuaaugucugggauguagguggacaagacaaaaucaggccuuuauggagacacuauuucagcggaacacagggcuugauuuuugugguugacucguccgacaaagcacguauagacgaagcacgccaagaauugcaccgcaucaucaaugaucgagaaaugaaggagucucugcuucuaguguuugcaaauaaacaag

SEQ ID NO: 347 - RNA, 532 nt, Artificial Sequence
  Synthetic
uauucuaagcuaucaucauuaguguggucaaagaaagagauaagaauucugauccuaggcuuggauaacgccggcaaaacaacuuuacucuauagacuuaaaauuggagaaguuguuacaacgauaccaacaauaggauucaauguggaaucuaucaccuuuaagaauuuaaauuuuaauguuuggguaagccuaaagcuuguucuuucucccccuuuucucuucaucuaagucaucuaaacguguaugacgaacuugcugcaaugcucaaugaagacgagcuuaaagaugcggaucuugguggccaaacaucuauacgaccauauuggcguugcuacuauuccaauaccgcugcaguuaucuucguuauagacucaacagauauugaucgauuagcuuuauugguuuuugcgaacaaacaggaucagccuggugcaaagggugcgggagaaauaagugaagccuugaaacuuggagagcuaagagaccgaaauuggaguauaguugcauguagugccguggaugggagugg

SEQ ID NO: 348 - RNA, 562 nt, Artificial Sequence
  Synthetic
ccauucuaauuaagauuucuuucuccauuuauguagaucuaaaccuacauguaucauuugguuaagggucucuaccacuacgcaacgcgcaaagaagaauacucgguucuuuugcugggacuugauaacgccggcaagacaacuuuucacgaacaaguuaaauuccuguuccugccucaugcgccugcacccaaaauaaauacgggaccuacagucggacaaaaugugagcacuauuacgcugccugacauguaccuuaagcuuugggauguagguggucaggaaucucuucgcaaacuauggaaaucuuacuaucgaucaugccacgccauuauuuuccucauugauagcacugagauuggugauggagauuuggagcaugaugagucgggucgccuugaagagugucgauuggcucuggaggaagucuuggucaauggagaaauugacgguguaccauuguugauauuagcaaauaagcaagaucgugaagauugcguugaagugguacgaaucaaagagggauuugucaaacacguuuuugaaggagcuaugggcggug

SEQ ID NO: 349 - RNA, 568 nt, Artificial Sequence
  Synthetic
auguaaaugugacucguuccgggaaaacuucggaaauauccaucuaugauguucuuguaggcgauguuuuacaucuugaaccuggcgacaugauuccuguugauggaauuuuuauuggagggcauaaucuuagaugugaugagucucaaauaacuggcgaguccgauauuauucgcaagcauccggcagaccaaguuuaugcugcuaucucgaaccacgaaaagcuagaaaaauuagauccauuuauuuugucuggggcuacugucacugaagguguggguacauuuuuaguuacuucaacugguguaaacucuaguuaugggaaaacauuaaugucgcuccgugaagauccggaaaucacgccauuacagucaaaauugaacaauuuagcagaguauauagcuaaacuuggaggaggagcuggucuauuauuauuuacagucuuauucauugaguuucuggcuagacuaccuaacaaugaugcuacaccaaccguuaaaggucagcaauuucugcaaauuuucauugugacagucacuguaauuguuguagcaguacccgaaggucu

SEQ ID NO: 350 - RNA, 596 nt, Artificial Sequence
  Synthetic
aaaacaugcuguuauugucuucgaugauuuaucuaaacaagcuguagccuaucgucagaugucacuacuucuucgucgaccucccggacgugaggccuaccccggugauguauucuacuuacauucacguuuacuagagcgugcugcuaagaugaacgacaaacacggggguggcucuuuaacugcucugccaauuauugagacucaaggaggagaugucucagcuuacauuccaaccaauguuauuucgauuacggauggacaaauauuuuuagaggcugaauuguucuacaaagguaucagaccagcaauaaacguuggucuuucuguaucucguguuggcucagcugcucaguugaaagcuaugaagcaaguugcuggcucgcucaagcuauucuuagcacaguaccgugaaguugcagcuuucgcccaguuuggauccgacuuggaugcugcuacuaagcaaacacucaaccgaggcgaacgauuaaccgagcuuuugaaacaaaagcaauauucaccaauggcuguuaacgaaaugguuccuauaauuuacgcagguguaaauggucauuuggaugguauaccuguuaaca

SEQ ID NO: 351 - RNA, 598 nt, Artificial Sequence
  Synthetic
ucauauuuugcuuguaguucaugauuucucagcucguagcucagaugaguugagcuuguccaaaggagaucgcguugaguugauagaacgugaugaugauuuuggggacggaugguuuuuaggccgucaucugcuaaauggaaagaguggccucuucccagaaguauacacacguauagcuccccgaggaucuuuaauaugcucgccagcaucaucguccauucaaaauucccauuccaaaauaaggaaaacuagcaacacaguuucuccacaaacuccuuuuucuggugaaaauacggucuccuugccaucagaaccucucaaaauguuagauacuccucaaauacaaccaacucuugggccccgggguaucaaggcuccgucaaacuuaacgauuacuaguccugaaacaacgauucaaucaaaaaguaucucgucuguuaauauuaagaaucaucgucaagauagcccuguaaugaaugaaacucuaagugucauugacgaacauaucacucauuuaaaaucaccucauggaauugucgauagagacagacagguaaucagugacucugguagugaguauagcagucagacugau

SEQ ID NO: 352 - RNA, 598 nt, Artificial Sequence
  Synthetic
aauaaauuucccucagaguauguucccacgguauucgauaacuaugcaguuacuguuaugauuggcgaugagccuuauacauugggucuuuuugauaccgcuggacaagaagauuaugaucgccuucggccucuuucuuacccacagacugacgucuuucuuguguguuucucugucaccucuccugccucguuugaaaacguccgugagaaaugguuucccgagguucaucaccacugcccaggcguaccaugcuuaauuguaggaacucaaacagauuuacgagacgauccuaguguccgagaaaaauuaagcaaacaaaaaaugcaaccagucaaaagagaggauggugagagaauggcaaaagaucuuggugcuguaaaauauguagagugcagugccuugacacaauacaaguuaaaagauguuuucgaugaggcuauuguggcggcauuagaaccuccagcccccaaaaggaagcaucguccauguuugauucuguaaaaauuacuaaaauuucuccuauucuucuucacaacacguauaucauuacuaguauuuuucgucacucguucuuucauaucgagcacagcacgau

SEQ ID NO: 353 - RNA, 597 nt, Artificial Sequence
  Synthetic
cuucagauuagcuccaucauuuacagauuuuaucggauaaaccuucauuccaagaucucaauaaauuaauaguagauauauucuuucuaggaaauuacgcccucuuaacuuuuauuacacaacuaugucugaagacaaugcuacucguaaaaaaacaguuaaacuugaggaugccucuggcgcugaacaaaagacgauugaugcuacugcgacugcuauuuuaaaaaagaagaaaaagccaaauuccuuaauuguaacagaugccaucaacgaugauaacucuguuauugcacugucaaauaauaccauggaaacuuugcagcuuuuucguggagauacuguccuaguuaaggggaagaagcgaaaggauacuguuuuaauuguacucgcagaugaugauuuagaugacgggagugcucguaugaaucguguuguccgacacaaccuuaggguuaaacauggugauauuguuacaguacauccauguccugauauaaaauacgccaaacguaucgcaguucuuccuaucgcagauacuguugaaggccuuacugguucccucuuugauguuuuccuugcaccuuacuuucgcgaagc

SEQ ID NO: 354 - RNA, 537 nt, Artificial Sequence
  Synthetic
augcugguaacgaugauagucuuuacgauuaaauuugaucacgucuuuuacauaacuguauucuaagcacaaaaagaaccgcuuuugaaacuucucucaccaaaauuuguuaucuacuacgucuuuuaucaauauuuaacuacuucgcgaugggaaaaccuuaaaaguaaacauccuguaccgcaguagaauaacuuuuagauauaauuuauucucaaaaauagugucgguccaauuuugaucaucauagucucugaucugucaaucugauuagacuagacgggguacuagaaagcugaucggucagcugagcaaauaauccguaaucuagaaauuucuuuugucuggauuacauuucuaucaaauuaaaauacguuaaauugaauaauuaauuuuacuugaucaucuagcuugagucgauuuaacaccugucguauauauuccgcaguauuccucaagguauuagaaauaucaacggguuuucuaccuuguuugcacaccaacccuuucuuagcuauuccucauauacgcguagca

SEQ ID NO: 355 - RNA, 594 nt, Artificial Sequence
  Synthetic
ugcucuucuaccucaucaccauagacgucaaucuucugcugcaggcucugacccaucucgacuaccuccaucaccucguuuaucaacugucgguguuccccaagcccguauuguuccacccuccauaaaagacuuugaaauaauaaaaccuaucaguaaaggugcauucggaaguguuuaucuugccaagaaaaaaucuacaggugacuacuaugcaaucaaaguacuuaaaaaagccgauaugguagccaaaaaucagguaacuaacguuaaagcugaacgugcaaucaugauguggcaaggugagagugacuuuguagcuaaauuauacuggacauucucaaguaaagacuaucucuacuugguuauggaauauuugaauggaggcgacugugcgucacuuauaaaggcuuuaggcggucuucaagaggauugggcaagaaaauacuuaggugagguuauccuaggggucaaacaucuucauagucgagggauaguucaucgagaucuuaaaccugacaaucucuuaauugaucagaaaggccaucuuaaauugacagauuuuggcuugucuagaaugggauuaaucggucg

SEQ ID NO: 356 - RNA, 471 nt, Artificial Sequence
  Synthetic
gaaauaaauauuuuaagucuggugauuauacgcgugcugaaauguuuuacacaaaagcgaucaauugugauccccaaaauccaguacuuuauacaaaucgugcaaugguacuucuuaaauuaucucuucaucaucguguaauugaagaugcccaaugcgcuuuacgucuccucccaucaaauaugaaagcauauuuccaacuggcccaagcacaacuggcgcuaaauuauuacgaugaggcauuucaaucugcaaagacugcgcgaaaauuuuguauggaagagauguaugcaggaacaaaaggggcuaacaguauagagccaauaacugaguuagugaugaaauguaaaaaaaugggaugggaggcacaagaaaguaaaagagagaugaaucgaaguaaauuaucucacgaacuucaauacggacuugaggaaagaagagauaaaaagauagcggaacucagaaauucag

SEQ ID NO: 357 - RNA, 560 nt, Artificial Sequence
  Synthetic
uaggucugugagucgaaacuuguuacccuacuuucgcuuuuugguuguucaauuucucaauagcauugaauuucuccuacugucggccucacggucgauacaagacugucuuuugcgguuuguuuuccauuucuacaacuauaccgaaguuaucugcuacacaccaacuggauacuucgaagaccagacauuaauucugucaagccauugucuaagauuucggcuaaagaauauugucaauaagccaaucaaucgacugaucgagaaucuugugacuuugaauugacucauuuacauaccuuaaauauccauacguggaaaggucuaaaaacucgaucacucuucauaaaaugacuggaacucaccggaugucuaucuauucaacuaccucuucagcguauggagguguucgaaauaacaauucuacuucucaaccuccagcgcaagucucaucgacuacucuccuaaacucaauccauacugcuuacacgucuacgcaaucauauaaacuugaugcaagcacuagcuuaguuguuaauacaugguuggcugcuucucaa

SEQ ID NO: 358 - RNA, 593 nt, Artificial Sequence
  Synthetic
caaaaaauuguuguaugucuaguauucgacggaaucgaucccugugauaaagauacucuagauguucuagccaccauugguauuuaucaagaugguguaaugaaaaaggauguagacggaaaagagacaguugcccacauuuuugaauauacuacacaguuauccgucacagcuaaucaacaacucauucgaccuacugaugauagcucuaauacauugccuccuguccagaugauguuuugcuuaaagcaaaaaaauagcaagaaaauaaauucacaucgauggcuauuuaaugcuuuuggccgauuacuuaauccagaaguauguauuuuacuugaugcuggaaccaggcccggaacaaaaucuuuauuggcgcuaugggaaggcuucuauaacgauaaagaucucgguggcgcguguggggaaauccacgcaauguuggguaaaggaggucgcaaacuauuuaauccacuaguugcugcucaaaacuuugaguacaaaauuaguaauauauuggauaagccucuugaaaguucauuugguuauguaaguguauuacccggagcuuucucugcguaucgcuuucgagcuau

SEQ ID NO: 359 - RNA, 593 nt, Artificial Sequence
  Synthetic
ucacaaucacuacacgaugugugcucaauuucauccaaaagaugauuuaguugugucggccucucuagaucaaucaguccgugucugggauauuucaggguuacgcaaaaagcacucggcaccuaacucaaugacauucgaagaccagaugucacgaaguaaccagaaucaggcagauauguuuggaaauacagacgcgguuguaaaguuuguacuggaaggucacgaucgagggguaaacuggguugcuuuucauccaaccuuaccauugauuguaucugcuggugaugaucgucuuguaaaguuauggcgaaugagugagacaaaagcaugggaaguagauacuugccguggucacuuucaaaaugcauccuguugucucuuucauccucaccaggaucugauacucucugucggugaagauaaaacuauuaggguuugggacuuaaauaaacguacuucuguucagucauucaaaagggagaaugaucgauuuugggucauugcagcucauccaacuauuaauuuguuugcagccggacaugauaauggcguuauggucuucaagcuugagagagaaagaccagcaucag

SEQ ID NO: 360 - RNA, 451 nt, Artificial Sequence
  Synthetic
gaaccauggcauauucuacuguugguacucccgacuauauagcaccugaaauuuuucuuggucaggguuauggucaggacugugacugguggagccuuggcacgauuauguucgaaugucaaauuggauggccuccauuuugcgcugaggauucucaugauacuuaucguaagauuguuaacuggcgacauacucuuuacuucccagaugauguccaauuagggccagaagcugaaaauuugauccgaagucuuauuuguaauacugaaaaucggcuaggaaggggaagugcugaugagauuaaggcacaucaguucuuccgugguguagacuuugauagucuucgaaggauucgugcaccuuuugaaccuaaacuaucaucaaacguugauacaacuuacuucccuauugaugaaauagaucaaacugauaaugccucucaacucagagc

SEQ ID NO: 361 - RNA, 554 nt, Artificial Sequence
  Synthetic
gucuucguaucucgguuccuaagcgcguacacuagaauuuaagcuugcuuauuuaucccgucucuacuuugaaauaaagacugcuaaccggguaguaacuacauuuagcgcauuucgauuugugguucaagccccuuaaguacgcuauguuugucaaacacaauugcuuauuaaguagaucuucuuuagacaauucuucuaacccuaacaccugccauaaauaauuacgauaacagucaucucuuuucccagccuaucagggcuggugcgagaggcaucgaaaauagacuugaauagucugucuuuacaacccccugcuucccaucuauauuacggaaccuaaaaaaacgcaccauaguugccauuauugucacuagcugcaauguggcaaauugcucgccaauacaucgaugccgacccgcaccaaaagguagauauggacuugacgcuccugugcuaguuaaaccauacccauaaucauacuucucaucaaccgcaucauuuccuaggacuuuaccugauccaaugucccaucgaugaggaucccauuugag

SEQ ID NO: 362 - RNA, 399 nt, Artificial Sequence
  Synthetic
gaaggcacggagacacguguuaaugcccaagaugaggcaaaugaauauaugguucguuaucuccaggcaugucgagagcaaggaaaguuagagaaugcaguggggugguaccacagucauccaggcuauggcugcuggcucaguggcauagauguuagcacacagcauauacagcaaucauucucggauccuuuucuugcgguugucauugacccagaucgcaccaucucagcugguaagguugaaauaggugcauuccggaccuauccagaaaacuacaaggcggcagaaucgucaacuaacgaugguuaucaaacgauaccacuaucuaagaucgaagauuucggugcccauaguaguagauacuacucgcugcagaucucacacuauaagagcucg

SEQ ID NO: 363 - RNA, 529 nt, Artificial Sequence
  Synthetic
uuuucaaucuauggguuuggaugcucaucuuuugagagccaucaaaagaaaaggcuucaauguuccgacuccaauccagagaaaaacaauaccucugauucuugaucaucaagaugucgugggaauggcuagaaccgguucaggaaagacagcggcuuuuguuauuccgaugauucaaauguugaaggcgcauagugcucgaguuggugcuagagcucugauucuauccccaucucgagagcuugccuugcagacuuugaaagucguuaaggaauuuucucggagcacugaucucaaaugcguucuucuuguagggggagauagucuugaagaucaauucagauuuauggcagccaacccugauauuauuauugcaacgccaggucgcuucuuacaccuuaagauugaaaugucauuagaccuuuccucggucaaguaugugguauuugaugaagcagaucgacuuuucgaaaugggauuuagcacucaacuuaaugaaauccuacaugcguugucaaauuccaggcag

SEQ ID NO: 364 - RNA, 597 nt, Artificial Sequence
  Synthetic
aauucaucugaauucgcaucuacgggcccaauccaucuaaagcaccuaauuuuuuuguucaccuagaucaauacaucagcgucauuauacugaguauuguauacaaaaucucgugaauauauguccagaaaucaaauuccccucacaaaucuauguaugggcucucacauagccaaaaaugaagauuaaagcacucaaccgccagucuuugguagaagcuggcucugauguccaaaaaguuccucgcaacuuggauccugcuuuacauccuuuugaaagagcgagagaauauacucgggcuuugaaugcuacuaaauuagaaaggauguuugcugcgccuuucauuacucaguuaggaaaaggucauguugauggagucuauacuauggcuaaagauccucaguccuuacagagauucgcuagcgggaguggugauggcguaguaaaggugugggaucuuauaagucgagaggaaacuuggaauacuacugcacaugaaaacauaguuaagggacugugcuggacaaaugauaagaagcuuuuaacuugugcuagcgaucguuauauaaaacucuaugauccauaucacacaccuuc

SEQ ID NO: 365 - RNA, 590 nt, Artificial Sequence
  Synthetic
auacuugcuugaauuuacaagcuuuccauuugcaaguauuuaauuaaaauauuuugaaaaaugucuaaacaaucuguucgcgcugacugggccgacgaugaagaucuuuccguugaccggauugaagaacaacuuccuccuacaacuacaacaacuaauaaagauggcucucaaacuaucguaaguuaucgaaucgaugaagauggaaaaaagaucaaauauaccagacgaauucguuucacuacacacaaagaaauuguaaauccuagaguugccgagagaaagcaguggaguaaauuuggacucucugcuaaagaucaacccggaccagauagcucaaccacaucuauuggugaaaauauaacuuucagaccgagugccaacuggaaaaaagaugccaaagaugaaaaaacagaggcaggaauaaugaaagacaaauuaaaagauaagaaaguuaaaugucguauauguaauggagagcauuuuacagcccgaugucccuuuaaagauacaauggcuccaauuggugaagaaaacagcggagaugcuuuaacuaguauuaaugaaacuacugaaggcccuagugaggu

SEQ ID NO: 366 - RNA, 499 nt, Artificial Sequence
  Synthetic
uuauuauggcacuggcgugaaaauaccuuaucccaaggcagauaccgauaaugcgagugcucauggauauacaaacauuaagggcgguaauccggaaggacgagcuuuucaccaugguagacuaauaucucagcuccguagaugcugcucccagaacccgaacaucaaaauuguugaaacgcugguuacagagacuauuacgaauccucaaacccaaacuguaauuggcguaaggucagagacaaugaaugauaaaacaggcaaaagagaagccgacuacuauuugggagaucucacaauuaucgccgauggauaugcaucuaaauuccgaaagcaguauauagacaagucacccaucguaaaaagcaaauucuaugcuuuagagcugauagauugcccuauuccaucuccaaaucacggaauugugauucucggugacaacucucccguauuacucuaucaaauuggaacucaugaaacccgcgcccucauugauguu

SEQ ID NO: 367 - RNA, 491 nt, Artificial Sequence
  Synthetic
aaguucgucaagaacuucagaguaaucaccuggcaaagucguugauucucuuugaguuagccauggauguucaagacauugaucaauauuaaugcguuuguuaacaucuacuguuaacauuuugucaaugaggucaagagcugagucuccuauauuaucccaauauggcgaugggaagucgaacugaccaauuuuaaucugcuggacaagaguguaaggauaaucauuacuggucaauucaucagagaauggcgggaagccacagaggcaaauguaaagaacaacaccuagagcccaaauaucaacagcucgauuguaacgccgauuaucugagucuucaaggaucucuggugcaacauaacuggguguuccacauaagcuuguugugaaugauuccucaccaacgaucuuggccaagccaaaaucaccuaauuuaauaguaggaguucuauucaugagaaguauauuuucggguuuuauaucucgaugug

SEQ ID NO: 368 - RNA, 404 nt, Artificial Sequence
  Synthetic
acaucuaccgagcuauauacaggaaauacccauauuucagauuuaaaacucaaaccuuaggcuggcaaaguaguguucgucacaaucuaucacaacaccaugcuuuccgcaaaguugaaaaggauggaaaaggcuggacuuggggaaucguugacgguauaucuauugaaaaagagaaaaaaaggagagcuacuccgccuccucaaucuuaucuaggucugcaacaaacuccuuaucaaaauggucucucaaagauagcaggccacuuuacguacagggccccgauggaaucuucacauaaucaauuaggucacuuuucaaauuaucagcuaccaccucguauaaaugggcaaguaccgucuguuaucaauccaucaucaaauuuuccuccuucaauuccuuua

SEQ ID NO: 369 - RNA, 424 nt, Artificial Sequence
  Synthetic
auaccaagaagacgauaacacaguacauauugaucuugguccgaguaagacaguaucccgaauacaugcagaaaucucauucgacucugacacagagucauggaacaucucuguucacggacguaacgggaucaaaguaaauaaucauccucuuaaacgcggugauucuauuucacucucuaguggcgaaauuauugaaauuggaggaguagagaugauguuugucuugccacaggaagauggaugucuuaagauagccaacuacuacuugcaucgggcuggacugauuucgucaccgcaugaaaaaauuacggagaaagcuaacgaaaaauccccuggcauacgaacaaucucaccugaagaaaucaacucaaaugagccaucaaaagacucuguccuaauuuccccugccccuccugaguau

SEQ ID NO: 370 - RNA, 448 nt, Artificial Sequence
  Synthetic
aaauucagggaguuggucaauuuuucucggcuucaagucuguuauugaaggccaaauuaucagauaucguauuuucauggcuagagaucuugcugcuccaaacgauacaugcaaagcaagcaaacaacgagauuuacugaagccauuugauuuuuucauugcaucggcagucucaggaaugaugguuucacucaccaccaauccaauauggguucuaaagacgcgcauggucaguucugacagagggaaaaacggagccuacgaaaauauguggcaaggcgucaaacugauauaucagaaagaaggagugaaaggcuuuuauaggggcgcuggcaucagccugcuuggcaauagucaugcagcaguucaguuuaguguguaugagcccauuaagaaauucuggagaaaauacauucguggagaucaaaauucagguagcagaucggag

SEQ ID NO: 371 - RNA, 598 nt, Artificial Sequence
  Synthetic
auauuucauaugguucugguaaaauucggaucggaguagauuaucgagaaacaaaaacacagucauuuaaaauugaagauuuugaacucuugaaaguuguuggaaaggguagcuuuggaaaagucaugcaaguuaaaaaaaaagauacucaaagaaucuacgcucuuaaaacaauacgaaaagcccauauuauuucucgcucagaaguugcacacacucuagcagaacgaucaguccucucucaaauuaacaauccuuuuauuguccccuuaaaauuuacauuucagucuccugaaaagcuuuaucuuguuuuagcuuuuguuaaugggggagagcuuuuccaucacuugcaaaaagaacagcgguucgauauaaaucgaucgagauuuuauacugcagaauuacuuugugcuuuggaaugccuacauggauuuaaugugaucuaucgagauuuaaaacccgagaauauucuucuugauuauucuggccauauugcauuaugcgacuuuggacuauguaaaauggaaaugaaagaugaagaccgaacaaauacauucugugguacuccugaauauuuagcuccagaacuucucuuggg

SEQ ID NO: 372 - RNA, 595 nt, Artificial Sequence
  Synthetic
uuccuacgguuacccaaagcgaucacuucauggccacucucauauaguuuccgacuguguaauuucuucugauggugcuuaugcucuaucugcuucuugggauaaaacucuccgacucugggagcuugcaacaggaaccacaacaaggagauuugucggccacacaaaugauguucuuucuguuucuuuuuccgcugacaacaggcaaauugucucgggcucucgugaucgaacaauuaagcucuggaauacucuaggugauugcaaguucaccauuacugaaaaaggucauaaugauuggguaucuuguguacgauucagcccaaauccacaaaauccagucauugucagcaguagcugggacaaacuugugaaggucugggaauuauccucuuguaaacuacagacugaccauauuggccacaaugguuacauaaauacugucaccaucucgccggacgguucucucugcgcaucaggugggaaagaugggacuacuauguugugggaucuaaaugagucuaagcauuuauauucucucaaugcuggugauuugauccaugcgcuuguuuuuucgccuaacagauacuggcua

SEQ ID NO: 373 - RNA, 590 nt, Artificial Sequence
  Synthetic
aucuuuggcuauauuaauuaucucauugaaaaggaucgcaaacacauucuugaaacacuugucaacggucucucucgcuuggaauaccguggcuacgacagugccgggcucgcaauugacggggaugaaaaagaugaaguuuuugcguucaaagaaguuggaaagguugcaaaauuaaagcaacuuguccaggagucgcaacuagauaacuccaaaguuuuugacucccaugcugguauugcacauacuagaugggccacccauggcccuccaucaagauugaauugccauccucaucguagugaccccaaauggcaguucaguguuguucauaauggaaucauaauaaacuauaaagagcucaaaacccuacuuaucucaaagggccauaaauuugagacagagacugauacugaguguauugccaagcuugcuaaguauauauaugaccagcacccaacaauuacuuuuacggacuuagcuaaggccgucaucaaggagcugcaaggagcauuuggacuucuacuaaaaucaguccauuauccccaugaaguaauugcggcaagaaaaggaucuccccuugucaucgg

SEQ ID NO: 374 - RNA, 598 nt, Artificial Sequence
  Synthetic
uauguugauugcuuggagugugaccgaaguuauccgauauucauacuucgucuucaaucucaguggcuauaacccaaaaauaauuauguggcuccgcuauaauacuuuuuacguucuuuacccgcuuggcauuaguagcgaauguugguuacucucgaaagccauugcaccugcuggcacacuucaccagaauuuugcuugguuucuccaaauaacucgguugaucuacauuccagguucauauauauuauucacccacaugauugcucaaagaaagaaggugcuuagagcggccaaagcugccaaagcuaccuaauuugauuaucuacuaggaugaaaaaaaaaaauccucugugccacggccaaaaauaauuuugagaacaagugccucucgaaagaaauccugucuuuauucgcucaaaagaaugaaaaauaaaauuaaaucaauaaaauuuuaucuucaacuacuuaagccgcacacguagguguuauauagagccaccacuaagaagauucgacuugaaauuuucagcgaaugaucaugauaacuagucaauguauguuuuuacuuaacccuaaggaauuuuacaccggacca

SEQ ID NO: 375 - RNA, 597 nt, Artificial Sequence
  Synthetic
auuuaacgaauaauuggacguugcuuaaaccagagaugcucuugauuggccugguggaacaaauucagggcucaaacgauccugcgaaacgcucuuuugcugcagucaucuucagacggauagcuucaaagacucgaaaauuacaaaauaaucagucaguggaaacauuuaucucuuugccgacagaacaaggacauauuaucagacaaaaacuucuugaagcccuuagcucugaaaccgaaacgucuacaagaaauaagauaggugaugcagucgcagaagucgcuaggcaguacuccgaugauaaguugcaauggcccgaaauucuagguguucucuuuacacucaguaugucgcaagugaugggccaacgugagauugccuauagaaucuucucaacaacuccuagaauaaucgaaaagcagcaugaagauacuguucuuucugcuuuuaccaagggauuuaaggaugaugacgugacaguccgacuggccgcuauggaagcuuucgcuucauucuucaggagucucaacaaaaaauccaagcaaaaauacuaugaacuuauaucagagguuuugaacauucuaccaccaauaa

SEQ ID NO: 376 - RNA, 598 nt, Artificial Sequence
  Synthetic
caaagaauuaaauuaaagcaggcuccauguugucagcuagcugugaacgcgcagcuugcucucugccccacgugacuaacugacugacugacugacaauuaaacagacaggcauuguuaugauacuaaugugcauucccguuuccaaugauaaaccacagcgccuuggaauacuaacagcuuaacucauuucuauccaagucucgucaacccuggcgccuuuaucucaggcuauaucacguuccacucaacuagcaaaucaccuucgaguuuuucauaaaaaaacuaacaucauggcuucucaauacuccauacgcaagauugcucagcccaauacucuugauuaucgaauauauauagaaagagauggaaauccgauaucaccuuuucaugauauaccacucuacgcuaauccugagggcacaauacuaaacaugauuguggaaaucccuagauggacuaaugcaaaauuggaaaucugcaaggagcaagcccuuaauccgauaaaacaggauaccaaaaaagggaaacuucgauuuguucgcaauuguuuuccccacaaaggcuaucuuuggaauuauggggcauuuccucaaacc

SEQ ID NO: 377 - RNA, 526 nt, Artificial Sequence
  Synthetic
aaaaauucuaaagaaaauucggaaucgggcgucucuaaauucaacguaccaccaccuuuuucaggugagaaaaacacuggaucuuuuauuucacaucgugcggggccuuuaauaccaccacgugaaacaauaccaccuuuaacucguguuuuucauacaaguucuucccaagucacaaccccucuugcuaaaagugagcaucucccuccuccccaauuaccuccaaaaauuccgauaguaucugcaucagcaacaccuccuuugccuccuuccucguuacguccuaguguucaaauaacuacucgagacugugaaaagaauagagagccaaauaguccacaaccucaaucuuucacagucucucaaauaccaaaaaaucccucaguuucuccagcuccaucgccaacaucucuucguguuacucaaacaucaucacuaccauuacuuccaguacaucaggcacaaucaucaccaucucucauagcagcucaagagccuuccucauuaccgccaccccucccgauau

SEQ ID NO: 378 - RNA, 595 nt, Artificial Sequence
  Synthetic
auuuauaugaaaguaauauugcaguauacccuucuacgaaaaauaaaaaagauucaucaaaaucccaaacucaugaaaagcaaucuuugggauucauauggcggucaggauuagcuggaggacuagcagggagugcggcaaaaacuauaguggcaccuuuagaucgugugaagauauuauuccaaucuucuaauccacaauuuuccagauacgcugggagcuggcucggcguugugacugcuauacggcaaaucaaagcuacugauggaauuaguggucuauuucguggccauucugccacuauaauucggauauuuccuuaugcugcgaucaaguuuuuaaccuacgagcaaauacgaucauuucuuauaucaucaccuacgcaagaaacaucauuacgaagauuguuaaguggcaguuuagcaggcgucgcuaguguuuucuucacauaucccuuagaagucauaaggguucggcuagcuuuugaaacaaagaaaggugcgagcucaagcuuuucacacauuugcaaaaucauauauaaugaaguuccgccuucgccucaauccauaagauuucccaaagaggcuguaaaaaa

SEQ ID NO: 379 - RNA, 598 nt, Artificial Sequence
  Synthetic
uaagcaauuugaugaugaucauuauggucuggagaaagucaagaaaagacuccuugaauauuuagcgguucucaaacuaaagcaaucaauaaaucaagacauugacaucaagauuaagaaggcaucugaagaaagagcacaugaaaaacuagaaaucuuaaaaagucagagaaugguugauaaaucgccuaucuugcuacucguugguccuccagguguagguaaaacaagccucgcaaaaucuguugcaacagcacuuggucguaaauuucaucgaauuucucuuggugguguucgggaugaggcugaaauuaggggacaucgucguacuuacguugcagcuaugccaggccucauaauucaagggcuuaagaaaguuggagugugcaaucccguuuuucuuuuagaugaaauugauaaaauugggaguucuaauuuccaaggugauccuagcgcugcaaugcucgaaguccucgauccagagcagaaucacaguuuuacagaccacuacgucaauauuccaguagaccuuagcaaaguucuguuuaucgcuacugcaaauagucuggauacuauuucaccaccacucuuagacaga

SEQ ID NO: 380 - RNA, 517 nt, Artificial Sequence
  Synthetic
aucagaauucuauaaagacuugucucccgaagcuguugacgauggaauucaaaauuauccaaauaucacucucagguuuuaugucuuuccuucaugcucuuucuagaaaaccuauucccuugugaacucaaucauaaccuuacccuaauauucuuuuuuuaaauccccaaacucaccuuuagucugaucuuuacuucaaaauuuuuuugacuucucaacucucaaaaugucuauuaucgacaaguccauucuugaaacuacugccaagcaugaggaggacauuggccgagcuccuucuuuggaaaagagucaguacuauaccacucagggugcccaucgugcggaagagcuugaaaagaauaugacugucaacgaagcucuaaaauugugguggccagcugcuguuuauaguguugcuaucucaacugguauuauuauggaagguuacgauaaucucuugcuugcucaauucuaugcgaugccaucuuuuugcaaaaaguaugguucgauggggccg

SEQ ID NO: 381 - RNA, 529 nt, Artificial Sequence
  Synthetic
aagauagacaaggcugcugcuaauaugaucacugaagucuuuguaaaauucaaaggucuugcuuaugaugaagcaguauggauggagcccccaaaaauugagaauaucgaaagauaucaaagcuuuauuaccgccuauaaugaauuuauugauggaaaauacuuuaggcaauccucaacuucagcuauggaccaucgcuuacagauguuccgaaaauuaaauuuuucaagaagaguugagaugaaagagcaaccucuacaacucacaggaggaaagaugaugcaauaucaaauggaaggucuaaauuggcuacuuuauaacuuccaucaaaagaaaaauguuauucuagcagaugagaugggcuuaggaaagacaauacaaauuauugccuuuaucguagcaauugucaaaaaucacucgaaauguuggcccuuuuuaguuguagcuccuaauucgacuugccuuaauuggcgucgagaaauuaaaaaaugggcuccaaagcuacgugucguuucuuauuuuggcucaa

SEQ ID NO: 382 - RNA, 483 nt, Artificial Sequence
  Synthetic
uauuuugcaaccuaugaagcugucaaacaucucaugggagguaaucaaacaggagcucaucauccuauugcagcaggucuguauuaagaauuuugauuaaggaaucagacauauaugacuacaucgccaauuuauccuugauauugagcacuuacugaagcuacauaguuacaaguggggcaugcgcauuacaaguggggcaugcgcaacaauugcaagugaugcuuuaaugaacccauuugauguaauaaagcaaagaaugcaaaugcauaacucucgcaaaauuuauagaucacugagugauugugcccgcuauaucuaucgcacugaaggcaucacagccuucuauaucucguauccaacuacucuuuccaugacuguaccauuuacagcacuucaacuucucgcauacgaaucuguaucuacauuucugaacccaucaaaggcuuacgauccacuuacucauugcucagcuggagcuuu

SEQ ID NO: 383 - RNA, 598 nt, Artificial Sequence
  Synthetic
uauuaugaguuuuguuaugcaugaacuuguuuauuuuggccgaaguauuccaugggugaucauaggauauauaccauauuucaacaaauauaaaauucagggucagaaaauuccaacugccaaagaacaaugggaauguacaaaacuggucuuaauaagucauuucacugucgagcugccucaaauuuggcuuuuucauccauugacaaaggcuugugguauggauguuggugucccauuuccaucauuaaaaacuaugugucuucagauugcuuucuuuuucguguuggaagauacguggcauuauuggaugcaucgauuauuucauugggguccuuucuacaaacauauucauaaaauacaucaucauuacucugcacccuucggacuagcagcugaauaugcuucaccaauagaaacaaugguucuuggcgcaggaacagucuuaaugccaacuguauggugucugauaacuggcaaucuucacuuaguuacgauguauuguuggauuaucugucgacuauuccaagcuauugaugcucacucagguuaugaauucccauggagcuuacaucauuuccuuccuuuuugggcugga

SEQ ID NO: 384 - RNA, 511 nt, Artificial Sequence
  Synthetic
ucaccuucaauagauggaguugaugauaaagccgaauucgaagcacucaaaaagucccuagcaacaauuggagucaaacaggaucagcagaccgaaauauuuaaaauacuugcagcauuacuacaucuuggaaauguuaagauuacugccacaagaaaugaaucuucacuuacuccuaaugagccuucucuagagauugcugcuucaauuuugggcauugauccgguggaauuugcuagauggacagucaagaagcaauuaauuacccggggagauaaagucguuaguagcuuaagccaacagcaagccauuguuguucgagauucggucgcuaaauuuguuuauucaagucuuuuugacuggcuuguugaaaauaucaauuaugcguuggcugcugaagaagucuuaagccgugucaagucauuuauaggaguuuuagauauuuauggauucgaacacuuugcaaaaaacucauucgagcaauucuguaucaacuacgcgaaugagaaau

SEQ ID NO: 385 - RNA, 473 nt, Artificial Sequence
  Synthetic
aucaguaucaacuauagagcuuguuuuuuuuacaugaguuucuaaaaugagagaaaccucguguggagugacaugggauaugauacccggagcagcaguagcaccauuauaaucgcccauagccuuaucaauaacaguuagcgcacucugugccaauuggcgaacuucugguagugaagcgcgaucuauuacaccucuaauuccagguuucagcuuuggcaaaaauauucgugcuucaacaggaucaugcacuagccuaguuagauucucaacaacgaccacugucugucgaaggacuuccugagugguugauggaguguugagagaucuuucuaguaaaggcguaaggagagcuaacacaggagaugucacuuccgcgacgaauguaguuugugaaagugcauguauugcuuuuuguaaaguugaaguugauggauucuucauagucgcuaugagaaguggaauacgaggag

SEQ ID NO: 386 - RNA, 598 nt, Artificial Sequence
  Synthetic
uucaaaaucuugccaacaauguucuauuuggugcuaaagaaccauacauguuuccacuuaaugauuuucucacucagaauauauauagggucacaacguuucuccgugagauaucggucucaccuagugcaguagagacugaaaucgagacugaaucuuuugacuuugggucaugcguugcuuugcauagauucuuauaugauaacugggaucauguucgacaaaaaguaggacuucuggagaggaagggagcaauagccccgucgacagauucugguguaguggagauaucaauaucugaagcgcuuuggaggcucauaacgaaucuuggaccaccaccaauggauguguccuggaaccgcccaguaaucuccuuaaauaguccuguaucauauucacgauuucaacauuuuaugcuccaaaauucuggaaggaauacugagucccuuguaucaacucgugcacuuuaugaugguggcgaaaguaaagauggucuuccaaugaucuguauaauacuucgcaacuuugacgcagaaacuacagauuuugagcuguuauuauuuggauuuuuaaaaacugcaagucguauguggcaucg

SEQ ID NO: 387 - RNA, 598 nt, Artificial Sequence
  Synthetic
uuugcgaaaaagaaaaaugguacgagguuauggaauacgcuccauaugaucuuuucgcaauaguuaugaccggaaagaugucgaaaaaugaaauaacuuguucguuuuuacaaauuuuaaacgcggucacauaccuucauuguaugggccuugcgcaucgagaucuaaagcuagacaacguaguggucaaugagcaugguaucaugaagauaauagauuuugggagugcgagugucuucaaauauccuuuugaaucugguauaacuaaagcaagugguauuguaggaucggauccguaucucgcuccugaaguuuacgaagagagaaaauaugacccacagccagcagauaucuggucacucgcgauuauuuacugcugcaugacuuuacggagauucccauggaaguuaccacgcaugacagauaauuccuauaagcuuuuuucuucugcaccaucuaugggaacagagcggaaucuuuuaucguauaaaucaacaacagauuuaguuccuacuccugaaaguccaccgucuauuucaaaaaagauagacucuucgucuacaccagaucuaaaaacuaaugaccaaccauccguuga

SEQ ID NO: 388 - RNA, 597 nt, Artificial Sequence
  Synthetic
uuauguuuacacuuagaaaucuaucuuguaaccucuaugaucauuauuaacgaaacuguccggguugauuuaauugucuuccuugcacuuuuugccgauuuagccacaauugcaguugcauacgacaacgcucacuuugagauucgaccuguugaguggcaauuaccuaaaaucuggauuaucucuguuguucuuggcauauugcuugcucuuggaacauggguauuacguggcucgcuuuucuuaccuaaugguggcaugauugauaacuuuggaucuauccagggaauguuauuccuucaaauuucucucaccgaaaacuggcucaucuuugucaccagaggagaugagacuuauccugcauuugcacucguugcugcuauauucgguguugauguacuugcaacucucuucugucucuuugguugguuaacuggcggugcuggugagccuucagauccugccacauuaaacucccuuuuaucuacugacggaagaaccuccauugucacuauuauuguugucuggggcuauucuauugcugucacgauagugauugcuauuguguaucauguauugaacaagucucagugguug

SEQ ID NO: 389 - RNA, 558 nt, Artificial Sequence
  Synthetic
aauuacuccuaagugaaaucguaaaagaugaagaaucugauuuagcugauauaugugcggagaacaacuccgacucuaagcuacuaacccauggaucuuuacucaauccacgugccacucgggcgaucgauauuuuuucccuaggccuuaucuuuuuuuauguucucaccagagguaaucacccuuuugauuguggcgaccgcuuuaugagagaaguaaauauuaggaaaggaauguaugaccuuaauccccuugagauucuagguaacuaugcguaugaagccaaagaacuuauaggcagcaugcuugauucagacccaaagugccgaccgcaagcucaucaagucauggcucaucccuucuuuuggucgcccauaaaaaggcuaaacuuucucugugauguuucagaucaauuugagaaagagaaacgcgauccuccaucaaaagcucuucaagaacuugagggcuaugcgcaacagauuuuugguaacgacuuccucaaagugcuuggaaaagacuuuguagaaagucuugguaaacaacggaaguacacaggaa

SEQ ID NO: 390 - RNA, 460 nt, Artificial Sequence
  Synthetic
ucguaauagccguaacagucauaaccaaacaaacucacaacacaugccuccuccaccacucccaccugucaucauaccacaaaacacgaacccaaucccgacagcuaucacaucgccuauaggugagaacgggacugugguuucaccuaacaauaauggagcuuuuucucguagagcggcuccugagccaaauaaaagggcacucuauguaggagguuuagauccccgaguuacagaggauguuuuacgacaaauauucgaaacaacuggucaugugcaaaacgucaagauuauuccugauaagaacguaggugcuucuaagggauuuaauuaugguuuuguugaguaugaugauccaggaucugccgagcgagcgaugcaaacauugaauggcagacguguucaucaagcagaaauccgcguuaauugggcuuaccaaucaaauacgucuaacaaagaa

SEQ ID NO: 391 - RNA, 521 nt, Artificial Sequence
  Synthetic
aaacaucaauuccuuuauugagacccgcaaaacucuugucaucacaaucagagagcuuuugcgucucaauuugcggaagaauaguucuaucacgaaauugacugaucgguuacuccaguccauuauaaaaauugcuccuccaaaccgaauuaauaaaguucaucaggucucccuauaaacgcagcacuuugcucuucuugagcaacucacuagaaguucguuaguucucugacaguguguacuaacauuacuucaucccaauccuccccggccuguucaccaagcaaacaaauauauucaucguccccucauuuguaugcuacacggagguuuuguuauaucccgauguacuuuucuuuaacuguuccguauccacuuucucucucccucucaaacucgauggcguugucacauuuuauucaaggaugcacgcggagauuaagacuuuauaccagguucgcgaggauaaaaauuaacauacagaaugccuaaacucuuuauuggcggucucucauggggca

SEQ ID NO: 392 - RNA, 591 nt, Artificial Sequence
  Synthetic
guuauuaugaauaaaaaagcugccaaagcagguuuaaaucagucacuuuuugaacgucuagucauguuggaaaugcacccuauucgacucaauauccaguaucguaugcauccaugccuaucagaguuuccgucaaauauguucuaugaaggaacucuccagaauggugugacgaugcaagagcggcuuagagaugaaguugacuuuccuuggccaguuggagauacaccgaugauguuuuggucuaaucucggaaaugaagagauuucugcuucaggaacaucauaucuuaaucgcacagaggcuucuaauguugaaaaaauaguaacccgauuuuucaaagcagguguucagccugccgauauuggaguuauuacaccuuacgaaggucagcgaaguuacguuguaagcucuaugcaaaacacugguacuuuuaaaaaagaaaacuacagggaaauugaaguugcuucagucgaugcuuuucaagggcgugaaaaagacuucauuguuuuaucauguguucgaucaaaugaccaucaaggaauuggguucuuaagugacccaagacguuuaaauguagcuuuaacucgg

SEQ ID NO: 393 - RNA, 598 nt, Artificial Sequence
  Synthetic
uuuugauguaugacauuuccaaucgcgaaaguuuucucgcucuugaccgcugguuugaugaaguagagacaaaugcaauaccuggagcugugaccuaccuuguugguuguaaaugugauaaagcgagcuugggguuaagaagagugagcagcgaggaagcuagugccaaggcgaagauuagaggagccguugguuggugcgaaguaagcagcaagacacgagagaauguaagacgaguauuuuccgagguuguggaagcugucguacgugauaaagaauugaugaaaguugggagaaggcaaacuggcgucgugaguguugugaauaaugagauugcaucggggucggucugucuuuguugaauuugaaagauucggagucuugaucguucuuuuuaauuaacgucuacaaauuggauuagagaauagggaguugcuguguuuggguuauaagauugaaugaguugacacguauaaccucuuuagucauacuaccucaagaguguugauucucgcuaucauuggagcuuacauaucuugacuuaaacuaccuaauuauuggagugcucuuaauuuaauggcuucagaucgaaugguca

SEQ ID NO: 394 - RNA, 594 nt, Artificial Sequence
  Synthetic
uauccagaaauguuaaaagguugcuuugguguaucugaggaaaccacuacuggaguucaccauuuauauaaaauguuaaaaaacaauacuuugcucgugccugcgguuaacgucaaugauucugucacaaagucuaaguuugacaaucucuauggcugccgcgagucuuugaucgaugguauuaaacgagccaccgauguuaugauugcuggaaaaauugccguuguugcugguuuuggugauguuggaaaagggugugcauuagcucuucaggguaugggugcacguguacuaauuacugagguugacccuauaaaugcuuuacaagcugcaguuucuggcuuccaagucaccacaauggaaaaggccgcaagucaagcucagaucuucguaacuacuacaggaugccgugacauuuuaguaggaaaacauuuugaaguuaugccuaacgaugcuauuguuugcaauauuggacacuuugacauugaaauagaugucgcauggcuuaaagcuaaugcacaaagcguucaaaauauuaagccccaagucgaucguuuucuaaugaagaauggucgucauauaaucuuacucgcg

SEQ ID NO: 395 - RNA, 598 nt, Artificial Sequence
  Synthetic
aauucuugaaacugauaggaaaaggaacuuuuggucaaguuuaucaagucaggaaaaaagauacaggaagaauuuaugccaugaaaguccuucagaaaaagguuauuguacaaaagaaagaggucgcccauacuguuggcgaaagaaauaucuuagucagaacagcuauggcagagucgcaguucauuguuggacuuaaauuuucauuccaaacuccaagugaucucuauuugguaacugauuauaugucuggaggcgaacuuuuuuggcauuuacaaagagaaggaagguucugugaagagcgagcaaaauuuuacauagcugagcucauuuuggcucuccagcaccuucacaaacaugacaucguuuaucgcgaucuaaaaccugaaaacauucugcucgaugcuaauggacauaucgcuuuaugugauuuuggucuuucaaaagcuaacuugaccaaaaaugagacgacaaauacauucugugguaccacggaauaccuugcuccugagguucuccuagaugaaacaggauauacuaagaugguugacuuuuggucauuaggcguacuugucuuugaaaugugcugugguugguc

SEQ ID NO: 396 - RNA, 447 nt, Artificial Sequence
  Synthetic
aacaauuuaauaugguaugacaucgauagagacucauacuauuauccagagcacucuuucgcucagcugucuuuucaucucgagaaucugcuaaccaucuauagcuuugcaucagaacagcugggcccaaguauucuucagaguuccaccaguaagaggggcaugaaguagaacagcaugcgcacaaaaugcacucauauaacccaucgaguuuuuuucuguccuccuuacuuuguagauauucuuuaccauugggugagggagauguacguugaagguauggcuugauggacuuauacuguuuguaaaacugugugagaucugggacgauguccuuaacuacauagguaugaggaaggggguaaaucuucguuucuuuacuaguaucugcugguauacgaccuguuaucgauguuaguuauuuauugaagauuguaacgccuaaaa

SEQ ID NO: 397 - RNA, 527 nt, Artificial Sequence
  Synthetic
augaccuugaauguguugccuggaauaggaaaguuccucauauuuuggcuacugguggaacuggaggauuuguuacagugugggacuuaaaaaccaaaaaagcgucauugacuuugaauaacaaucguaaagcuguuggagcuauugcuugggauccagaaaauucaacgaagcuacuaacagcaacaccugaugauacaaaaccaguuauucuucuuugggauuuacgaaauuccaaugcaccagaauguacauuacaaggccauaaucagggaauuuuaucaaucucauggugucaacaagacagcaauuugcuguuaucauguggcaaagauaauagaacuaucuuauggaacccacagcuuggagaacuccugggagaauuuccugaagcuacaaacuggaccuuucagacucgauuucauccucauaauccagcacuuucugcaacugcgucuuuugauggcaaaauuucuauacagacacuauuuaacacaaacucucuuacaaaacacccagaagcucaa

SEQ ID NO: 398 - RNA, 574 nt, Artificial Sequence
  Synthetic
ugaacauuuaaauaucaagguuacagauaacaauaaugaagucuucuucaaaauuaaacgaacaacaccacuuaagaaauugauggacgcguucugugagaggcaagggaaaucacuuucuucuguucgauucuuauuugaagggagucguguucaacaaacugauaguccugaguuucucgauauggcagauggagauacgcuagaggugcaucaagaacaaaucggcggcaacaucuggauuugaaauucacgaaacaucgaacgauaucuaaaaacuaauucuagguagguaaggaaaacgaacuucuuguuggcggugauuaaauaggauauaaauuuauuauuuucaauugauuuuauuauuaaaaaauuucaucccgauauguuuacggcgcgcauuguccaauuuacuaagaaaauuugaauucguaugauuuagccaaaaaucuagaaaaucgauucucgucgagguuaaucuaagaaaauccaaucaaaguaucuuugaaauuuacaacucuaauagaaucccauaaaacgccaacuccugauuuaguaucuaaggcagguuuau

SEQ ID NO: 399 - skipped

SEQ ID NO: 400 - RNA, 463 nt, Artificial Sequence
  Synthetic
aucuaaaaccagcaaauaucaugguuaccucaucuggugaaguuaagauuggcgaucuaggccuugcucguauauuucauaaaccucuucauccauuauucacuggugauaagguuguugugacuauuugguaucgggccccugaacuucuuuugggcucuagacauuacaccccugccguggacaugugggcuauuggcuguauauuugcugaacuucucucauugcgaccaauauuuaagggugaagaagcuaagaucgaagccaaaaaagugguuccguuccagcaaaaucagaugcagagaauuguugagauacucggaguuccaacaaaggaaaaguggccuaauuuagugcauaugccagaauacagucagcuauccacugucaauucuaaccaucccaaaucuuuccuugacaagugguacuauaacaaaauuaaugcgucacggucaucuccuac

SEQ ID NO: 401 - RNA, 456 nt, Artificial Sequence
  Synthetic
gagucugauugcaauagugcuaaaaaacaaggugaccuugguuucuuugguagaggugauaugcagaaagaauucgaagaugcugcauucgaacucaaaguuggagaaaugagucaaaucauagaaacagcaucuggucuacaucugauucaaagaauagaauagauucgauuugacaacuauaacaccauauauauauauauauacauauccagucacauuuggagucucaauugcaagcuugaugcgcaagacuuacagagacuugacccagaaauaugacuuacugcuucauuuuuuucgguaaaaauuugaauauuuuuauucuuauaccaaaaaugauauuuacugcuacauacuguaacguugaauugaaccuuaauagguauuguaguuuaaugccucaaaaauucagauaauaaaaagcaaacucgauggcuuccagaugaaguauua

SEQ ID NO: 402 - RNA, 586 nt, Artificial Sequence
  Synthetic
aguuaaauugggaagaaaccuugaaacuggagauuuuguggcuauuaagauuauucagcgauuuucaaaaaagcguaggcugggucgaguuacguuuucacccgagaauaaaacgaagcgcgaaauugcuauucugaaaaagguccgacaugccaaugugguaggccugcuugaaguuauugacgauccugaguugaagaagaucuacaugauuuuagaacaugucgaacuuggagaaauuccauggcgaaagaaaggaacagcccaaauaugccuauacgagcgacgaaggauugaaagagaacaaauuggagagcagaguuaugaugaugaaaaauauuuucggaugauggaacgacgacgacuucguaagcucgcucagcgugcgcagauuucacaaaguauaauggagucaaauccuaauuacuggagucuugaauauggccaugacgaagaugaagacuucucaacagcaucuagagauaauacuaguggcucucacauauuuccaucuuuugaaucacuauuuauuacgaaaccugacucucaaaucucaucccguacauccucaagaccugcuucaggu

SEQ ID NO: 403 - RNA, 590 nt, Artificial Sequence
  Synthetic
aaauauguaugagaacuuuaaagcuuucaaacccaucauauggugauuugaaucauuugguaucugcagucaugucagguguaacaacaugucuucguuucccaggucaacucaacucagaucuucgaaaguuagcaguuaacaugguuccauuuccucgucuucauuuuuuuaugguuggauuugcuccucuaacaagucgcggugcccacucuuuccgcgcaguuacuguucccgaguugacucagcaaauguacgaccccaaaaauaugauggcagcgucugauuuccgaaacgggcgcuauuuaacauguucagcaauauuucgagguaagguaucaaugaaagaaguagaggaccaaaugcgcaauguacaaaauaagaacucugcauauuuugucgaguggaucccuaauaauguacaaaccgcacucugcucuauuccaccucguggucuuaagaugucaucuacauuuguaggaaacuccacuuccauucaagaacucuuuaagcgcguuggggaucaauucacagcuauguuuagaagaaaagcuuucuuacauugguauacuggagaaggaauggacgag

SEQ ID NO: 404 - RNA, 573 nt, Artificial Sequence
  Synthetic
aacugguucacgaagauauuauggagaugauagaucgugaggcugaugguagugauucacucgagggcuucaugauuuuacauucgaucgcuggaggaacaggauccggccucgguucuuuccuccuggaacgacugaaugaccguuuuccuaaaaagaucauccagacuuacucuguauucccagauacgacuaauucgggcgauguuguuguucauccauauaacagucuacucuccaugcggcgccugacucaaaaugcggacucgguugugguuuuggauaacggugcauuaucucguauugcagcugaucgccuacauguucaggaaccuucauuucaacagacuaaccaauuggucucuacaguaaugucggcuagcacaacaacucuucgauauccaggcuacaugcauaacgaucuuauuagcauuguggcuucucuuauuccaacuccccgcugucauuuucucaugacuucauacacgccuuuuacuggccauaacguagagcaggccaaaacuguacgaaaaacaacaguuuuagauguuaugcgccgacuucuucaaccaa

SEQ ID NO: 405 - RNA, 568 nt, Artificial Sequence
  Synthetic
guuccaucuaagacaaaaguuaugguugccaaucuuccuuaugacuuauccgaggaaaaguuaaaggaacuauuugccgauuacgaaccaguaucugccaaaauugcucugcguccuauuccaaaauucaugguuaaaaagcuucaggcccgcaacgaaccucggaaaggccguggguuuggcuuugugaacuuagcaucuaaugaacuucaaaauagggcuguugccgaaaugaauggaaaagaaguucaaggucgugagauugcaguaaagaucgcaauagauaguccggacaagaccucugaagaauuaacuacacauguaucugauggugcuggcgaaguaucuaauguuggcaacucaaccgaagguacuaauggcgccaucgcuaaagggauuacuaaugauaaacuucaaucagaaggacuagcugggacagcugaaacuguugcggcuacagcuuaaguuaaaccgcaacuuuuaaauggugagaugauuccguaaugucaauacucgagguucugguguguagcucggaaaauuaugaagguaguuugggcaguaucug

SEQ ID NO: 406 - RNA, 598 nt, Artificial Sequence
  Synthetic
aaaugcuuuuauuguauaugguggggauacuaaaauggacgauucugacguauuagaugaaacucuuuacuuacuuaauaccucuacccgacaaugguccagagcuauaccugccgggccacggcccgcggggcguuauggucauucucucaauauacuagggucuaaaaucuacguauucggggggcaaguagaggguuauuuuaugaaugaccuuguggcuuuugauuugaaucuuuugcaagucccuacgaacaggugggaaauucucauuaaaaauagugaggaugguggacccccaguaggacaaauaccaucagcuagaacaaaucacucaguugugacauauaaugaaaagcuuuacuuguuuggcggaacaaauggucuucaaugguauaacgauguuugguguuaugauccgauaccgaacuccuggacucuuuuggacugcauaggauauauaccgguuccaagagaaggucaugcugcagcaauuguugacgaugugauguaugucuuuggaggacgggcugacgauggaucugacuugggagauuuggcugcguucagaauuacaucaagaaggugguacacauuu

SEQ ID NO: 407 - RNA, 598 nt, Artificial Sequence
  Synthetic
auuagcucugguuuccauucuuuuaagcacgugacuauugcguguaauucuuugucauggauuggguaauuagcuucggcacuauuuaacuucuucgagaaauaagccacaggucuuauuuggccguguucauccaccugugagagacaaccaccaauugcaaagccagaacuaucagcuuccaaaauuguuuccuucucuggaucccacugugcuaaaacaggcugugaugagaauauuucuuugagccuuucaaacgcaucauuuucgucacgcccccaucgccauuccaccuuuuuuuucgucagggcaacuaggggugauguaaugucggaaaaucccuuaauaaagcaccgauagaaguuggcgaauccgagaaaugaucuuaccccucuaaccguaguuggcgcuucccacuccagaauggccuucaccuucgauugaucaacggccacacuuuuaccagcuuucacaauaaaccccaaauauuugacuucuuuacauaaaaacucacauuuaucaauaucgagauauagcccagcuuuucguaauuugucaaguauacuucgaaccguucuccaguguccauccucgcuac

SEQ ID NO: 408 - RNA, 580 nt, Artificial Sequence
  Synthetic
uugaacagaaagaaagcaugucuauccguaucagauccucaucucaguuugacaaaauuuugaacucuucaaaaguagucgucaccgauuaacuaaaucuacuaauggcuggguuaguuuaugccgacuggugcggcccauguaaugcuauugcucccaccuucgaaagucuugcuuccaaauacucgaaaccgaacaggaucaccuuugucaaggucaauguagacaaucaccaggauauuucucagcguuauggaguuagagcacuucccagcuucauuaucuuucgaucuggcucuauugccaauacgauccguggcgcugaucagucuacuuuaagaacugcuaucgagucugucaucagacuugcaggccuagaaggucuaucauauaccucagaaggacgaacucuagggaguacuaagaguccgaguacacaguugucuaagccauucgauuugaaacaauugauaaauacuuuuuuaucuuuuuucggauuauauuuuguaaccuuauucucccuggaugcuuauagcgcuggggaaaacagcucauuuaaucguaauagcgccccggucag

SEQ ID NO: 409 - RNA, 594 nt, Artificial Sequence
  Synthetic
uaauucaguugauguaaauuggauuuacaggaaguauucaagaugagugaagucaguaaaauugaagacaagaugaagauggaaguugaugagucacaagaaaauaauaauguuaucgaugagucuuuauacaguaggcaacucuacguucuuggacacgaggcuaugaaacgaaugagugcaucgaauauucuuauuauuggcuugaaaggucuugguaucgaaauagcuaagaauauagcucuggcuggaguuaaaagucuaacauuauacgaucccgcucccgcaacuaucgcugaccuaucaucucaauucuuucuuaacccagaagauauaggaaaaccuagagauauugucucagcucaacgaguuucggaacuaaaugcuuacaccccuguuaagauucacagcuccacaagcuuaguuucugaucucucccaguuugauucauaucaagcuguaauauugacagauauuccacugaaagaccagcucauaaucucccaguaucuacaugagaagggaauauauguaguaauaacugaaaccuuuggauuauuuggauauauauucugcgacuucggcgauaacuuu

SEQ ID NO: 410 - RNA, 580 nt, Artificial Sequence
  Synthetic
uaacuuugaacuucuuuuaacgcuccccucagacuauccuuuuaagccaccaaaacuaucguucaaaacucguaucuaccauccaaaugugacuuuugaugagcaggguaguauguguauuggugcucucaaaccagaugccuggaaaccaucaucucgaaucaucaauauuuugauggcaacgcagcaaaugcugaccgagccgguacuugaugaugcgguagaaacggcauuagcagauagauacaggaauaacaggaaugaauuuaaugaagaggcgguuaaagcgacaaaaaaauaugcuaugaaaugaguggaugaauuagcaacgaagauuuggacugaaaugagucauucaaaggacagagacgaacacacaucugcuauuaggaaucguuccaaaaggauaggauuaauauaauuuuuugauuaucuauggcagcaauaagauuuuaaaccucacaucgaguucauacaucaauaguacacaauaauauuucauauauaguauuuuuuuacaagacgcaaaaucucuagauaguuugagcaaacauuuauguguauuuaaaacuagagucaa

SEQ ID NO: 411 - RNA, 527 nt, Artificial Sequence
  Synthetic
guuuucaauucacuuuuucuaucucucaaaacuucccucaugaagcgccaaaaguaaaauguauagaaaagauuuaucauccaaauaucgaucuugauggaaacgugugucucaauaucuugcgugaggacuggaaaccgguccuaaaucuacagaguguagugguaggauuacuuauuauccauaauuuuuuuguuuguuuguuuuuuguuuuuucaaagaaaaaaauauacauuagccucaauaccauucuuagagccauuuuauaacgugugugucuuuuuuuagguaucaucgaauacuccuuccugcucuacucuggucuaguucgcuacuggaauucuuuaauuauuuuucucuuuuuagagccaaauucuucggauccguugaauaaagaagccgccgaagaucuucggaaucaucgugagauauucaagagaaauguuagaaauaguauggcuggcgguacuauuaagggccaaacguuugauuguguucuaaaaaccugaugaguuuuuuuuuuggaa

SEQ ID NO: 412 - RNA, 560 nt, Artificial Sequence
  Synthetic
uucaagugguuaaucgcucuaauaguagucaacccagaaagugcuuucgauggggcuuauuuuaaggcugaaauggguuuuacugauaaauauccuuaugcuccuccgaccuucaaauucuugcaaccuauuuaccauccaaauauauauccugauggcaggguuugcaucucaauacuacacgcugcuggagaugaugaacaaucuggagagcuugcuugugagcgcuggucaucaauucagaguguugaaaguguucuccgcucuauucuucucuuacuagaugacccugagauuaccuccccugcaaauguugaugccagcguuauguaucgggauaaccuggaggcuuacaaacagcgggcuuuggagacaguaagaauuucuaugagagauauaccggaggguuuugugaugccaaaaacauuaauugaggcgccuccuccgcaaauuaaugaugacgaugauuucuggaacgagagugaugaucaggaugaguucgguaccagcgagagcucagacgaugauaacuaugauuuugaacaagacgaggaugacga

SEQ ID NO: 413 - RNA, 586 nt, Artificial Sequence
  Synthetic
auccgaauuggucucauucccgucaucagaaacucaaaugcugcaaucgaagcaaaaguaauuuaucaccuuauugaaauuuauggauuacaaacugcaauagcauauuuacggucacaaaaugaaucaaagcuuagcuuaaacaguaaggauguauucgaccaaaucacccagaaagcaaaaauuaagacuaauaaaacccgaauaauuuucgacgaaguuuugaaaucagaugagcucgagagucgaauucaaucgucccaaaaauggguagacaggauuugugcagaugaccuuguucccccaguuaucauuaauggcguuguuauaccgaaagaugaauucuggcuucagaaaaugagucaacagauauauacagaucuacaauuaauucagcaaacuauuguccuugggacagaaaaugugagaagucaagauuuuugggugccuaguauauuuuuaaaucaagcgauaaaucgcagaaauaaauugauuauuccugaaaaucgaaaagaucugaauuuuuuugacuugaauuuuauugaaaaaaaaagcucugaguuuuucaaggauuugccuagauuuu

SEQ ID NO: 414 - RNA, 595 nt, Artificial Sequence
  Synthetic
auuuaguggcaacaauggucauucggcacgcaucaauaccguuacuuuugcuggggauggagccagucuucuuauuaguggagguuuugaugccagugcucguaucugggaugugaagagcucgagugcuaagccaguuaugguucuaacagaggcuggugauagugugagcugcguauuagcgagugauagcgagauauggaccaguagugucgauggaaaaguuaggaaauacgacauuagaaugggacaaauuguugucgauguuauuggugcuccugugacaugucuaaggaagacaauagauaaaaaaggucuacuuguagguggacuggauagucagcuuagacuaauggauaccgagaaugguaaauuacuaaggaguuaucgugcagauugcugggaaaacaaagaauuucgaauauggaacuguuuugguggaagagagagauggauacuuucuggaaacgagaauauugaaggacaagauggugaagugguugucugggauacauugagcggaaaacuugucgagaggaucacaguaaaaggaacaaaguuugaugguaagagaaagguuggaagagauggcaag

SEQ ID NO: 415 - RNA, 590 nt, Artificial Sequence
  Synthetic
uguuguuggaucagagaagcaucaauguuaagacuugacaugucauucacaaucacggcaauucgaaggccauguucauuagagcgcaagauaugcucgagaagaguugucuuuccacuucccagaaauccagauaaaagugucacggguaauugucugauguuugauuuugacugcucgucacuugauucuuugacauuuggaucacuugaagaacgcaagucagcugucgcaauuggagccauugugucuaguaauucuuucugugccucaaacuauuuuucaauaugagucaguugauugggaacguagaccaaggaaacgucaacgaaugaaaauuacagucccgaagagcuagaaucucccuuuuuuuuuucucccaacuucucagcuugcuucacgaagaggcaaugcgagagaagcccgguaaccaucgggauuccagucccugagcguccaaaaauuggguuccugccaaucaaugcuguccugcuacggcgaaucuuuaccgaaucucaaaauucaguccaucaaggugauuuucuauugaccaaccaaaaacgaucuauuggcaagcacacguacugaaa

SEQ ID NO: 416 - RNA, 556 nt, Artificial Sequence
  Synthetic
aucuuccacauggcagaaugguaauuagaccaaauuuuaaguuuugcauucagguauauagccaaauaaacgaaaccagaaaaugcuacagucgauuggcuugaagggaaugauucaagagaauuauugaucugccuuuugucgccagugcagacauuucugucguacauuauuauucuaggcccauaucuagccuuuauuggagcacguguuggaauuauuggcucacagacgguuagaaaaugaggucucagcccuccaauuaaccacuuuaagaagacuugaaacacuccggcgauaauaagggaguauaauagcccuguaaucgcguuguuugcaucccaaaacgagcgaauacgaaauuguguaaggaaaaugaugagcaaaggaauaagugaagccaacaaaauugcuacccaaauuggaaugauauucuugcgaagaggauaugcaaauugaggauaaacaauaucuccauuuugagaauaaaucggaaaagaucgagauggaauugguucugcaaaauuaauaaugaugccaaccgucccuaagagaa

SEQ ID NO: 417 - RNA, 545 nt, Artificial Sequence
  Synthetic
aaaguugaucgcaaaaaacuagaaaaagcggaacgaaaaauugccgcuaaacagagcaaaaagguuuuuaaaacaguucaguacgaagcuucacggcuucuuaaucaagcagauaauacgcagucauacgaagaauuuuucauggccgucaauccccuucaacuuggaucguuaaaaggccagcaaaagugcaaagauauaaaacuugauggaauugauguaucuauuggcggcuuaagaauacuuacagauaccaauuuaagcuuagcguacggucgaagguauggucucgucggucagaaugguauuggaaaaucuacuuuguuacgugcacuugcccgaagagaacuagcuauuccuacucauauuucaauacuucacguugaacaggagauaagaggagaugauacuccugcgcuucaagcuguuuuggaugcagacguuuggcguaaacauuuacuuggggaacaagugaaaauuucaaagcaacuugcagaucuagaauuagaaugcaauucuauagcugaaaccuccaucaaugcgga

SEQ ID NO: 418 - RNA, 556 nt, Artificial Sequence
  Synthetic
aacaccaaaauuuacuugccucuucuuccgccgacaagacugucaaacuaugggaccuuaauacuaauaaaugugcuaaaucauauaguaaucauucagauaaaguuugcucaauacaauggcauccuguugacuccacugucuuacuuaguggaaguuaugaucggagugucguagcggccgacaugagagcaccagaauccaaagugccgauuugggguguagaaagugauguagaagcugucaaaugggaugcacacaacccaaauuucuuuuacguaacgacagaaggugguaugguccauuaucacgauauacgaauggcaccaucuacucccaguucuaguaagccaguuugguuauugcaagcacaugacaaaucaguuugugcuuuugauauuaauccuaucauucccggguuuauggccacagggucuucugauaaacucguaaaacuguggaauauucagccaucgggccccucaaugauaguguccagagauuuggaaguuggaaagguauuuucaacuucuuuugcgccugaccaagaaguccg

SEQ ID NO: 419 - RNA, 477 nt, Artificial Sequence
  Synthetic
uugaccucauugagucauuuuugcuaaagaaugacuucaaauucacucgauaugauggaaaaaugagaaaugauuugcgugaagcuagucucaacagcuuacgaaaugauaauucuugccguguacuauuaugcaguuuaaaaugcggaucccucggauuaaaucuaacagcugcuacccgcguuguuauccucgaaccuuucuggaauccauucauagaggaacaagcaauugaccguguacaucgucuuacucaaaaaacugauguaaucguuuauaaaauuaccauugcuaauaguguugaggaacguauucucacgcugcaagaaaaaaagcgugaguuagcucaacaaacgaucgaaggcgguaaaaacaaugguauuagcaaguugggcaugcaugaaauaaugcaacuguuucgaggcgaagccgaucauaauuuggugucuucgguuaaggaugccaaaaauucgggga

SEQ ID NO: 420 - RNA, 595 nt, Artificial Sequence
  Synthetic
uuuucaacuaugauuuaaaauuuaccaguaaauuauauucacaauccuucuuauaccuuaugaaauguguugaacauguuuugguuuauuuaaaauacaguagcagccauacuagacauacuagaugcugccgugaaagauaugacacaccgcaacugcauuugcuuaaaugauuaaccgauuuuaugcggucaagcuuuauaacaucaccuaggagauuauagagaucaaacgauaaaauacaaugaggcaugucuucgggcucauauuaucaucagggcgaucaaauuccaccucaagcugauucggacuccgaucuggauuuagauauccaggagcuugaacaagggaucaaaccgaaagcgcaugacuggagaacugaaagcaauauuccguugagaaaucuacgcaugagcggauucagaggguuaggaagaagaaauggggccccaaggaauuuagacuacgcugaagaggacuuacauagcuuauugagggacgacccagauguugagggaacuggcagauacaacccagacagugcugaagaucauucucuguuacccucaggaaauggauaucggucgcgaagaga

SEQ ID NO: 421 - RNA, 539 nt, Artificial Sequence
  Synthetic
uguuuuggguuuuuaucagggcuugaucccaugggcuuggauugaagcuucaucaaaaggugcaguucuucuauuugucgcuucagaagcagaauucuaugcucgaaguuuuggagccggcaucuucacagccggcaucacaggaggcguugucggggguauggcucaagcauaugccacuaugggcuuuuguacaugcaugaaaacuguggagauuacgaaauccaaauuagcauccacugguguaaagcccccaggaacuuucucaacauuuauggauauauaccguaaagaugggaucagagguauuaauaaaggugugaaugcuguugccauucgacaaaugacgaauuggggauccagauuuggauuaagucguuuggcagaacagggaauccgaaagguuucaggaaaagaaaauggcgguccauuaagugcuugggaacgaauucucgcuagugcccuugggggaggguugagugcguggaaucaaccaauugagguuauucgaguugaaaugcagagcaaaagaagauccu

SEQ ID NO: 422 - RNA, 598 nt, Artificial Sequence
  Synthetic
acaugaauccuugaauauucuuauuggcaugcaugaucugcuugcaagaggaguauuuaagccgcuagcugcucuugauuuuuucucaccuuucgcacugaaucacgcaucacaggaaauagauuuaauugauuuacaguaagagaacgagaaugcucuacggacuguuauucgguggggucucuuucucgcaagagaaggauaucccagaucagucagagaaaguaauuuucauuacaggagggacuagagguauuggauaccagacggcucuugcucuagcuagaaaaaauccugcgcauaucuacaucucaggucguaaucagacuacugcugauaaggcccuggcaaguaucaaaagugcaguuccaucagcuaaagucucauaccuacccugcgacuuagcagaccucgaaucugugaaaucgugugcacgggaauuucuuaacagagaaaagagauuagaucucuuguuuuugaaugcaggaauuauggugacacccgcgggaaaaucaaagcaaggauaugagauucaguucgguacaaaccauauagggcauuuucuacucacaaaacuacuacuuccgacguuagagaa

SEQ ID NO: 423 - RNA, 596 nt, Artificial Sequence
  Synthetic
aacgaaaaucaauucaauuccgaugagaguacuguaaccaaugaugaucugagaauaucuccaugugacgauaauaucgaugagaccucuaaagcuucaguacuuacuacucagaagcaaacagauauaacugugggagcuggauuaaaaaaagccacucgaaauaaguaaggagggaauuccuauucuggggaaaagaaaacgacgaggcggcauuguaucuaaauuuucucuugauauucgcaagccugucaccgaugaugaaucagaaugggaagguauaaacucagauucaaguaugucaauccagcgugauaccauaggaaacaugacaaauuccucagaagacguuggagauaaaauuggaccaaauuuaucugauuacgagucagauagcaguaaagaaaguagccgugaugagaaugaaaguucugaugauugcgaugaaauugagaauacgccuagaaaagaaagaucugcguuuaaggcuugggcuauccagcaaauaaaugaggcucaaggauauaaaucaauaccaaauauucaaaugguaaaaacucugccgaauaaucuuaccaucaaguuaagggcaccag

SEQ ID NO: 424 - RNA, 481 nt, Artificial Sequence
  Synthetic
aaagaaaaagaaauugaagcuaggcuagcucaauuggagacucgacucaacucggaaggaaaaugcgauaucauaagucccgaugcugcagcuccccggcucgaaagaaauuggaauauggguauagauuugaauuuggcaauugaugguaggccucuucuuacauccauugaaacgucgccaccuauuucaggcuucucccagaugccuaaagaaacuacaucaaauaucaauaaagagcuacuaagcuuaggucuucaagaaccauuaccgccugauuauaugauuaaagaauuauaucauaucuacuucacucucuaucacccuucaaugcccaucauacaucaagcccgguuuuacaugucuuuggaacguccaauucagacccguccuccaauuugucuaugcuaugccauguggacauuggcuacuacacuuucaccuaaauacgcugauuaugaagauauauuuuaugaacgcg

SEQ ID NO: 425 - RNA, 598 nt, Artificial Sequence
  Synthetic
caucuaugaaaauauuucgugaagaagucuucggcccuuuuguugucauaaauagcuuuaaaacagaagaagaagcccuaaagauagcaaaugauacuaccuauggccuugguagugcaguauuuaccaaggauauuacgagggcucaucggguagcgcgaaaaauugaaucaggcaugguauggauuaauucaaguaaugauucaaguuuuaaggucccauuuggugguguaaaacagaguggaauuggacgggagcuaggagaagcuggucuagcugguuacacucaaaucaagucaguuuuuguaaauaugggagcuuaaaccgucucgcuguagcugguuugcaguuaacugauaauuuggcuaauuaaaaaaaaagcguuagucagugacgggcaucuuuuaauuuuuuauuccuucauuaaaggcagugauuagggcaacaauaauaagauagauauguugucagauuggugaauuuucaauuuaaaaguuaggaguuuucgucauccuaccaaacuuccguauguagaucauaauaugcgucgaacucucuuuuagaauguauaaaucaauacuuaagccagggaugggua

SEQ ID NO: 426 - RNA, 554 nt, Artificial Sequence
  Synthetic
aucaagucuuagucaguuaucuuagcacuuagcauuaaacaucuuauccgaccacuacucauucucauucaaauucgaauuauuaucuuucuuuuuuauuuuugagucugccgacuuccuuucacacucguuucaaauuccguauaauugacucauguuuuuguaacgcuucacggauuauuuuugauauugaagcacauauccuagaccggcaucgccaaaccguaacgauaggcuacuuauggguaaauggcgaugggggguuaucuuagacgcgggcucgucagggacucgaguccacgucuaccgguggcucaauacaucucgagcucguuacgaugcaaaaaaugagauucaauugaaccaacuaccucaguuacacacuaaaccuggauauucaaaaaaaaucaaacccggcgucucuuccuuugccgaucgcauaacagauauugguccugaacaucuucaaagcuuacuagaucaugcauugaguauuguaccugagaaucaaguuaaagauacucccuucuuucugauggcaacugcggguguua

SEQ ID NO: 427 - RNA, 456 nt, Artificial Sequence
  Synthetic
uggucauagacaauaauacuggucgaccuaaaggcacuggcuuuguuugcuucuauagacaagaagaugcggacucuuguuaccauggugcaccucguaccuucaaaaguggugcaaacgcuguuaaagcuaaaaacucuauuuuagaggaugaaacugcugauaagaauggcuuauacacaauagaaggucgcguacuucaagugucaagagcaguuaaucgagaaaaagcuguaaaacuuacagaagcugggacaaacuuccgcacugaccgagacaaagauaagcgaaaguuauaucuacuuaaagaggggacaauugcuguugguacgccuauauauaacguuuuaucuccaucagagauuaaacuuagagaagcuucggcgcuacaacguaagaaacuuauagagaaaaauccugcacuucaucuuucacucacccgucuaucgauccgua

SEQ ID NO: 428 - RNA, 553 nt, Artificial Sequence
  Synthetic
ucaaaagaaauauuuuauuuugcuuauauuucuuuuuucuuuaaauagagaaucgcaaucuuauauauucgacacccauccccaccuaaucaccacaccugcagcuuuugcugcgguaccucuuguccaacccuuaacuucuccgacauugcauacauucgacacuacuugucgguucacuauggauguaauggagcucguugaaaacgaaccuaaugcgagaccauuucagugugauuggcagacaugucacaagaguuucaacaggaagucugaccuucaacgccacuaucgaauacauaccaacgaacggccauauucaugcaugcagccuggauguggaaaaaguuucauucaaagaagugccuuaacugugcacauucgaacacacacuggcgaaaagccacaucaaugccagcaucuugguugugggaaacgauucucugauucaucuagucuggcucgucaucgucguauucauacaggaaaaagaccauacaaaugugcacacgagggcuguuugaaaucauuuugucgaaagaccacaaugguc

SEQ ID NO: 429 - DNA, 1163 bp, Artificial Sequence
  Synthetic
caaaccctcccctcccctcccctccacccctaacaacaacaacaacaacaacaaggcgtcgttccgttaaacgcctaattaatctcttatctccacaatacacacatgctgttcccgcaataaatagtcttctaatttcaactccacgtggaatttgaaaagaagaatttaaaatatctctcaatctaccaatcttaaacaccgcaaaaagattagtaaatcgtaacctgcaacagaaaacaaaccagtccaagagcagcgaaagtcgactaaattgattccaatcagcacttaaaaaatcgtctgtcaaaagagatgtcgtcaaaatcaagtccaccaacgttcgctacttctcgtactcgtgaaggtcgcagtatgacaattgacctctcatcattaccacctctcaacataccatcaccagcatctaacacacttataattacgaatatcgaaaattctctagtatttcgaaacgaaaaccttttaaccgtcaaagctcttatccataaccttaccccaatacattcatgggctcctctcaaatcttttcgccgaattattgtctcttttttcgatattaactctgcgattcagatacgacagttgatcgaaagtgaggctatgttaggtgaacgttgcaaagtttattttggccatcccactccaattgaggcaaaagaagctcacctaaacttacccgacgctgggaaattgttttttatctccccgcccccgagtccccctcatgggtgggaaaataggctagaggatgctcctaacaagcaagtggtggctgaagatcttgcaaaagcattgaaaaatatacgcgacggaaataaaagctgcttcccagatagtcccattagtgatcgtggggaaactggatatcgaactcgaagtacaagttgtacaactatttataggcccgaggaacatggtggtagcccaaacttacctgcgataaatgtagaggatacaacaggtgataattgtgaaccaattcccatggagcacgaaaagcctatctatgcacatacgagtagacctccactagagttgatggatgtttgcctttgttgattttttttgctatggatttttattattctgctagaaatatttttgtgttgtgaagagacacaggttaatggtgttaggag

SEQ ID NO: 430 - DNA, 583 bp, Artificial Sequence
  Synthetic
ttctcataacaacagttttgcttaatatcttgatagcactgtttaattctgcatatcaagatattactgataatgctattgacgaatatctggccctattttctcagaaaacaatgcagttcgtacgcgcgccagatgagaatgtcttcatagctccattaaatctagtagaaatctttcttctaatcttgccttttgaatggtggctgccacgtcaaatatatgctcgattgaatgaaatggttttgacagttctttatttacctctactcctagttgcggcttggtttgaaacatgcagtgcgaacaaagttacagctaatcggagccgaggtgaagatgatgatgatactctccaagaatgggaacagttaatggctgaaaacgattttaatactgatggctgggataaaagagttcaatgtgtgaagacaaatattgaagaggatcaaactaatgtagagattttaaaattgatacacgaagttgaagaacttaagagcctactgaaattaaatttagaaaagatagcgtaataactatgataaacaattccatatatttgttaaagcttataaatgac

SEQ ID NO: 431 - DNA, 2064 bp, Artificial Sequence
  Synthetic
ctgaagctttactcttcatattatttttattaatatttgctattgcggcatcctggtatgtttgggatgaaggtgttaaaaaggacagaaaacgttcaaaattaatgcttgactgtattttgatcatcactagtgtagtgccacctgaattacctatggaattaagtcttgctgtcaacactagtcttgctgctttaagtcgctatgcgatatattgtacagagccatttcgtatcccatttgctggtcgtgttgatgttgcatgcttcgataaaactggaacattaacaggggaagacttggtagttgaaggaattgcaggtcttgaattgagtgaaactggaagtggccaaaaactccagactaacagcgcaaatattcatattattcctgtagcacaagctagtatggaaactatattagttctagcaactgctcatgctgtggtaaagcttgatgaaggagatattgtcggagatcctatggaaaaggccactttaacctctatagggtggacacttggaaaaaatgacactttatcatgtcaaaaatctacaacagcagactctcttaacgcattaaattctgtgcaaataaaacgtcgatttcaattttcgtctgcgctgaagcgccaaagctctatagctatcattacgaaccaaaatcctggatccaataaaaaaatacgcagcacatttctaggcgttaaaggggcacccgaaactatcatgaagatgttaataaaaattccaacaaattatgaagaaacatataagcacttcactaggaaaggttctcgcgtactggctttagcatttaaatttctagcaaccgactctgagcttagcattgggaaaataaacgaactcaagcgtgaagaggcagagtcagaacttcactttgccgggtttttagttttacactgtcctcttaaagaagacgccaaaaaatctatccaaatgcttaacgaaagtagccatcgagttgtgatgattacaggcgatagtccactgacggcgtgtcatgtggcttatgaggtagatattattgatagaaacgttcttattctggatgccccagaccatgatggcaatggagaagatctagtatggaaagatattaacgacactatcagtatatcagttaacccaaaccggccgattgatcctgagatcatcgctaacaatgatctatgtattactggatacgcattggcaaagttttccgacaaggaaatactcaaaacaatatatcgtaactcgtgggtttatgcacgcgtctctccaaagcaaaaagaagaaattctaatgggcttgaaaaaccttgggtattatactctcatggccggagatggtactaacgatgttggcgcattgaagcaagcacatataggcgttgctcttctcaatggatcccaagatgatctaaatagaatcgcagaacactttaagttgacaaagttgaaagagctctatgaaaaacaatgtcaagttttaaaaagatttgatagacccaatccttctgttccaatagccatagcacatttatatcctccaggccctataaatccacattactcagcagctatggcacgagaagctgagaaaaaaaattcaaaccctcttaaaaacactgcaacacaaactagttctaaggaggttggcttaagtaccattagtaataaaaattctcttataaattcgaggcgctcaaaaggacaagatatgccaactcaggctagcagtttggcagaaaaatttagtcaaagtatgatggatcaggagcttgatgatgagccgcctacaattaaacttggtgatgcctctgttgctgcaccatttactagcaaattaagcaacgttattgctatacctaatattattaggcaaggtcgttgtacccttgtagccacgattcagatgtataagatccttgcactaaattgcttaataagtgcttatagcttgagcgttctttatcttgagggcatcaaatttggagatggtcaggtcacaattagcggaatgcttatgagtgtatgctttttatcgatttctagagcgg

SEQ ID NO: 432 - DNA, 518 bp, Artificial Sequence
  Synthetic
atatcgatgatatgatagcgtattccattaggtactcttaactctgctacattacaaggtatttcagctagtaaaagcaacatttcttgtatcaagttctcgttccacttatgtttttttaatatttcaaaactagcagcaagataccgtcttgttaggagcaaaaatttttccatacgtaaaacatcaatgctggtccactcgcgttgcatggtttgccaaaatccacgtagaaatggaatgacactctcaagtggcagtatgaagattaactgagctaatgaattggctagaccttgctgtgcgagcggtcgatcagacatccacatgcaataaaataggcctttccataatttcagtatttcaataggtgtcaaatctcgtcgacctgaaagatacgttcttaatgattccaatgcagagtcacgtgattgtttgtcatttgctactagttgtttaataaacggtgtttgatttacatttgtcaccatattgtaggtatccggattttgagtccg

SEQ ID NO: 433 - DNA, 915 bp, Artificial Sequence
  Synthetic
gctctactaatgctgtactacatcttattgctatcgctgactctgtcggtgttaagctgactatcgatgattttcaagcagtctctgatcggactccgtttcttgctgacattaagccttccggcaaatttgttatgcatgaccttcacaaaataggcggaactccatcgctgatcaaacttcttctgaaagaaggaattattgatggctcgggcataacagttacgggaaaaacgcttgccgaaaatgttcagaatgtacctgattttccaagtgatcagacaatcattcgacccttttctaatcctattaaaaaaacagggcatattcagatattacgaggctctctggcacctggtggctctgttggcaaaattactggcaaagaaggcttacgatttgtcggcaaagcaaaatgctttgatgctgaagatgactttattactgcgctcgaggatggaaagattaaaaaaggagaaaaaacggttgttgttatacgatacgaaggtccgaaaggtggtcctggtatgccagaaatgttaaaaccatcatctgctatcatgggagcaggacttggaaatgatgtggctttgatcacggatggtcgattctctggaggctcccatggattcttgattggccatattgttcctgaagcacaagaaggtggccctcttggcttagttagagatggtgatactattgtgatagatgctgaaactagggtattagacctggaaattcaaggaggggagaaagaactagaaaaacgtcgcaaagaattcgttcctaaaccacccaaatatatcaagggtaccttagcaaaatatgctagagtagtgagtaatgctagccgtggatgtattactgacggcgagcttgaaaattaatttctttacaatgaatagaaacgcc

SEQ ID NO: 434 - DNA, 672 bp, Artificial Sequence
  Synthetic
caactttgaagcaaattagtattaatggtcttaataaaaaaactcaatctacgcaagactcgttaacttctcagctcatcgctcctgagcctgaacattgtcctggtccggagtctctcagtgctggcaaggctgaatcctgtgctggttgtccaaatcagattatatgcgcatctgcacctaaaggaccagatccagatattcccgcaatcaccaatcagttatctgaaataaagcataagattcttattctttcaggcaagggtggagtgggtaaaagtacatttacaacactgcttgcacatgcacttgcaaaagacccggaaattgtggttggtgtcatggatacagatatttgcgggccaagtattccaaaaatgatgggagttgaggaagagattattcacgtcagtaatacaggatggagtccagtttgggtacttgaaaatctagcagtaatgagcgtgcaatttatgcttcccaaccgagatgatgcagttatttggagaggaccaaagaaaaacggcctgataaagcaatttttaaaagatgtagaatggggcgaaatggaatatttattagtagacactccaccaggaacaagtgatgaacatttgagtgtcaacacttttttgaaagagagtggaattgatggtgctttagtattgacta

SEQ ID NO: 435 - DNA, 2730 bp, Artificial Sequence
  Synthetic
tgaatatctataaattaaggtgcccacctctatgatcaagtgctttaacattttctctctcttttaatcattaattagacttgctcataatttagtccatgtaaggtgtgaatatttgtatttttttatgcgcgcattacccgaagttattgacaacctcgtaatttggaaatcataatgacgaaggcccgaacaacatacaaatgcctcgaaaaatactccaatatgatgactatggccctatcttgagagagatcaacctatcttctgataacgactatctggaccaattaattcctatactaaaagatgccatactctccaatcgcacttctattcttcagcagaatctttcccaatatgcaagtgagctggactctgatatagagaacataggtcttactaaacacgacgaatttcttcaatcagtcactcaactacagaacttacgagaaggcactgtcgccctcactaaggaaatcttgcaactcaaccagtctatccaagagagtacagaaaacttatctgaaaaaaaaagggcgctagtagacacaactgctatacgacaaaatattgctgatgcatctgaggcactcaaacaaagcttaaagattcttcacgcggttaacttagcgcatgaattgattcgaaaaaagcagtattatggtgctttaaaagcacttgatgatttacaaattgagcaccttattcctgcgattcaaaataaatatgctactcaacttaaacttgcagttcttattcaagattcaataccgtcatcccgaaaagtaatatcagaggctgttatgtctgatttgaacacatggctatacagaattagagaaacatcacaatttcttggggaggtagcattttatcataccgaattgagaagaagccgccagaaagaaagaataaagacaaatcctctactcggaaaatttaaactaaattctgccattgagcttgtatttgatgagactgaagaatttaacgttttggataatgaagagttgcaggtcgattttactccactgtttgaatgtatgcatattcatgaagctttaggtcaaagtgacaagtttaagtctcaatatgctgctacaagaaaacaacaaaaagagttacttttacccaactcagtgagtttggttgatgacgatgaaaaaagttttagcggactattagaaagtattgccggctttgctattatagaaaaagcaacattaaagaaggcgcaggacctccgatcaccgattgatgttgatgaattgtgggactctatgtgccagacagctatcaacttaattaccaaagctctggatgatgttgatgatgctgagttactccttaaaatcaaaggagttgtcgccttatttatacagactatggagggctgggggtattctattacaagcctagataattttcttcttaccctgtttaaaaaatatgccacaatactggagaagaaattcagcgatgactttttagagattgtttcaaatgatgactacatgcctatgccagttaataacattgatgaatatgataaggttgtcaatgttagctggtttaaacctgataaaccgcgtgaagaactcacctttccttgtgtatttccattctctcaaatgtatcctctttgttgcattgatatctgcaacttcttaaatcaattttacttcttcagtgatgatcattttcggcatccctctgtaattgataatacactgaaggcatcacttgacttggtcctttctgagaatgtttgcaattcattagtagaccgtctgtctgttcaatatctcggccaaatagttcagattcttattaatttagaacattttgaaacagcatgcttggagctcgaacaattgctcatggcagctagaagtaataatacatctggtggaccaatcatactgaatgcaacagaaaattttagaagcaataagaaaacagctgaaaaaagaatatttgaactagtcaatagtaaaattgatgacctagttgaaacagctgaatatgattggactgcgcagactctctctcctgagccaagcaattatatgcaaaccttgactacttatctttctaatataatgtcctcaactcttctcgctcttccaccgtctatcaaagagctgatttacttcgatgcattatctcatgcgacagcctccattctttcgctccctctctcacctcaagttaaggctatcaatccaaatggcgttgctgctcttgcaacggatgtattttatctcgaacaatttgtctcaacactaccaaacgctattttattaaaggatggccttgatgaattattacaagttgtggcgctcatgaaatcagagaattctgatgaattctatgatgtagccgtcagaaatcgtaaatttgggagagtagatccgattgttggagcaaacattttgaacaaacttacgcataccgtacaaagctcaaagcctgttgatacaacaggtgcaacaactcttttaggcggctttggcagtagatttatgaagtcttgaaacaggaagaatgaatataaattaagaataacgacatcactttctaacaaatcgtgtattctagttgttatcaatagttttaaaaaaagaaaaatttaactcatgtatgatgagtctcaaggatttaggtgggaactcgtaaattgacaaacgagaatatattgcagtaacatacaagattaaaattcac

SEQ ID NO: 436 - DNA, 2043 bp, Artificial Sequence
  Synthetic
attttatccataattaatgtttctgattagagattttgattttttttaaaatgagtgtttgttaactatatcgaacacacgaaacttgcttggcttgggactagtttgtgacagagctttcccaaaatttttgtagtaatccaataatataggaatggcgtaatagtagacgattcaagtatttagctagtcaagaaaaagctcattttatctatcagccccaaatcagttttgcatatactaaatattatcttctatgcttcccatgagatctcacttccctacatcttgttaattattatcatctcttatttctttagtaacacggctcgatctttaattcttcaaggcttaattattttatgccgatagggtgtcccactacagtagaaagtaagaaattaaatttcttcattcaaaaaaaaaggccaatgtagccttttatgagtattgcgatgaactaaacaatagaatcagagcataaggtctgccaaaaaagccataactcagtttctaattttttttctctattttgggtcaacacctcaatttgatcatatattattataaacttgcttaatttttgtagctgctctgagaaattgaaaaaaattttaaggatctttcgtaaaatcgtcaatcggttggctttcggaatcgacattatgataatcgagaatttctgaatacatcattattttccaagtatccactggtaggtccgcatcattgaatgaccagtcaaatttttcttctgatactggttcatcacttggatcatgataaggggcaagatactcatgcgcaagagcttcaccagcttttacacgttttcgtggatcgaaaatgagcattctctcaagtaaatcgattgcaagtggatcggcatttttgaaatggttcttcaatgactgtctttctctttttggaagggattgtacaaatctcaaagtgttttcgctagctattgtgtgaataacatcatctggaggagttcctaagagttcagtgattatagaaaattgattgacatggtcctttccaggaaaaagtggtttattttctaacatttcagcaaatatacagccagcactccagatatcaacttcaacgtcatatttttgccacgtaagcattatttcaggcgctctataataacgagttgaaacataaccagtcatttgaggatcctgaatacgagccaggccaaaatcgcagattttaagatcacaattttcattgacaagaatattgcttggcttcaaatctcgatggacgacaccagctgaatgtacatatttgagtcctcttagaatctgataaaggaaatattggatgaactgtttttgaagtggcctagaagctaacagtcgatgtaggtcagtacctaaaagctcagttacaaaatagatatcctcaagtggggaaataaaaatatcactgagggagataatattctcatgctttaaatgcttcaataacttcagctcacgatatgttcttttagagaggactggggtgctgaaaggcttcataattttcttgactgcaacattttggccggttaagttatctttagctgagcaaacgagaccgaatgcacccatacccacaggctgaaggtcagaatatctcgaggtaatctcgaaggtagtcccgaagatctgagctcgcacaaattctgccatgatgagggaaattatcgtatgaaacttctgagagctgagaagtgatggtgaacttgatggaggtggggtcggaaaagcgtgaggaaaagtgctagtgagacgcaagatccgcagagttatttagtcgttttatagtatcattccttgtaaaatgtgggtttattatagtcactctgtctcagaccaaagatccaggaagtctacctactcacagcgtagcattcaaaatgaggagcctcgcataatttcagtcataaatatgaaagaacaaagtacatttgatagctcgggtaactagtcggagcttgagttactgcccgtagcttatgttgagagctaaaaatatggtggacag

SEQ ID NO: 437 - DNA, 831 bp, Artificial Sequence
  Synthetic
ctggaatgataattgatactcccggtgttatcagtcaagggaaaggcggatacgatttgatatcacacattgtctccgaattttctgtcaatattattcttgttttaggttccgaaagactacacagcgaattacatcgtcgcttctcttccctcaaaacaaatacaggagaatcaataaccctaattaagttggataagtcaggaggatgtgttgacagggatgaagaatacttgaggcagagtagagaatgctctattaaagaatacttctttggcgtacctaatagtactttaagtcctcatacgctccagattaattttgacgaggtttttatttacaggattaaagagataaattcattatcatttatgcctggaggcgaagaaatttttgaccaagaattatacgaaaaaatagagcctaatctatcgatgatgaattgtattcttgccgtaatgtatgcgtcaggagcagactcacaggaaacaatacgagatgcaagtgttatgggctttgtttatgtttctgaggtcaatcagaaaaaaggaaaattgaaagtgcttgcccccatgaattccaaaatcacagaaagacctctaatttggggaagctggcctgaacctactgtgagtatcataagttgaaattttcttaccagataaaaacaaaaaaatcacatctaaattgaaaagaacatcatttgcaaaataatcgggctttagaaaaaatggtcaaaatggccatttttaattataataccagaatcatgaaactttgtgactattttctcaaaataagaagtattcatttttcggagcagcaatcaaa

SEQ ID NO: 438 - DNA, 3654 bp, Artificial Sequence
  Synthetic
ttatagacataataaaattgagattcataaatatttagaaataaattaagtcaaaaagattacggaatctaaactaccggaacaatatcattcataaaatcatcaaggctatttgattttaaaatcaaaatacatgcccgcttcttttaaattttagatcaaaaaaatagaaggaaagacaaaatattttcataaatttgaaaaggagagaaaattttggcttttatagctattatgtgttgacataattagccatacatttttgaaacaagtcatatcacaccttggctcatatcaggcggatttaatccctcaatttttcccttggccctcctattgcaaaaagttttttgagtaatatatcttagtaaataaaaaaataattaaaatcggagaatgtaggcaagtcgttaaaattcatcaaaagttccaattcgtctagcattttcgtttctcttgcaagacataaacttcatctcccatttttaatcatcgcgtccactcgtcctttccctaaatcattaacatatcgatagaaacataactagactcataattcattcttcattttttgcatggaagaaatacgccgttttttttcatcagagaattgaaaagatacagataaatttaaaccaaattttgagtttttcatcaagttcaagttggttaaatccatatgaaggttttttttagaaaaaaaaaactttaaattactccatgttgtctaaatttttataatacttattgtgaacttttgaaaacgtttcagattgagtttatcgccgacgttggttaatcggtgatgtggaacagatttttcctggtgaatcatgacttagaatattagaaggtatcaaaattttgcgtcgtttcatagcttcattttcatttgcaatagctctactgttggatttgatgtcatcgtctactcgtgcgcgtttttttcctgagctgtgtgggttttgcggagagtttaaatatccatttgctgtcgctacattatcaggaggcgtagaaaaagtttctgtagtgtgattactgttgggactaccacgctctgaacttataacattataaaggttactggagggtgctggatgtcggggagaagaagtataattctgaggttgtgaataaaaagtttgtgtaggtcccgtagttcttggagttgcacgcccagatggagttgaggcctttgggtgatttggtgagggggatatctcagagccatgagtatattccaattcattctcttgctctttctcttcctcatttgtactctgttgatgactttgattatgagtattactcaaatttttggtctcgtgactctcagactctgtatgaagggcacgtgatgaagaagacacaagttcatttttaagataagtattgttactgttactatttgaatttgatgtattgtgcgaagaagatgtagagtagcgattattaacttgttgatcatggctcgagtgtggataaatattttgttgactagaggcggttattggtggtggaggtggcggtggtgcagagtaaacatgtcttggcggatcatatgactgaccagtctgtgtatattgtaagccatgaattgatgtaccaggaggagttgacgcaggtgtatttggaactgaacgagaatgggatattccattctcgatctgcatcgagttcccactcagtacatgtccgattccgcactgtgatccccattggaagttactgtcagggttactcatgctgcccattacactagaagcacttgttggtggagttggaaaattttgaatccgatcaaggggtggacgtccccaattagggtgaggagtaagagaatgggatggatctccttgtatatttgacattgctgtattcatggatgggtgatgttgatgaaatgaggacatcccatgagagagagagtttttaatctgttcttgatcaagtttccgacgctcagaagctgcaataacttggttggctcgcgattggttagttgggtgatataatagttgtgctatatcttgaacgaaaagaggatataaaatatctgtaatcttctctttattggccatctcgagcgcacggtcgaaaggtatccagactccctttaaatgcattgggccaattttaacaacatgccggtgcttctcgcttttcaagataccatctcttcttcctctagtcataccggcaacatttaaaagttttgttccattaatcatatgattatcttctcttcgagccacacaaactcccttggcctcaacttgaaagcaaaggcttccttcatcctcccatagtgtagcagtaacttttggtttcattcctggaggtgcaatttggccagtgagatcaaatccaacaggttgagacgggtatggttgactagaaacgacgttcgaggatccagtgttgagggaggtgggcagaggtaagacgtttccctgttgacacatatttgccgatacttgatggttacccgattgctgagtcgtataaccgttagagtaactgtactggccataaggtccaggagatgaggcgtagtggggatggccagattgcacatgctgtgaatgttgatgtggagaaaagtgtgacaaagcattggaagtgggtgtttgtggtggatggtgagcatgacccgcggacagatgagatgggtaatacatttcttggggattgtgattcattgcggagaaaggttcgtgagcgcaaatataatttggtgcgattggagaagtattactatacggtgtttgcgccagagataaaggtaatcctgcactgttgggcagcaccggagacggagttttgggccccgtagaagattgactagttgaataaggtgataaagagctaccgttcagaacaacggaggatgttatcgaaccaagacgtggagagtaagcctgtggcggctggggtaaaggtaaatgaggcaaccgatcattcacatatggcgatttttgaccagcgtaatgattatagagaggtgcgtcagtaggtccacgaacttggacttgggatattgatgggagatccagcttttcggcgtctgagggggaaagccctccgggataggggaggtttgggggaagaccggctgctagtgaaagatcgtttttaattgttgcggtggaaaccggaaagatgacttttttggaattaactcttttttttttttgttttacaataagattaatctgaccaattccaatactgataatgagttagaaaccagcaagcagtacaacacgagccgaaggaggaagaatcgtggtggagaaaaatgcaaactaacggcttggtctcgtatactttttggatcttaaacgtggcataaataataacatgtagagttgtaaaacgacgatgcagcggaatatgaataaacttgatatgcaaagtggatagggcctctctcatccgtgtgcctcaaagaccttgaaaacaggagaaatagacagctctcatgcaggtacgtcagttgtatggatggatgaagaggctggcgcaaagaaggcgtagtattgtacaacaattcgtgaagggaagcaaaatacgttgtaaggtactcgtttggcacagtagattgaaattaagtgacgaaaaaaccgttatccccgctttggaagggaa

SEQ ID NO: 439 - DNA, 840 bp, Artificial Sequence
  Synthetic
gcgaaagaattcggtctacccatgctatgtgcaagtccatattccattgagagaactatccaggcaagccttcgtcttaaatctagttgaattgggtcgacagggcccagtgatacatcttgagcaattgttttttcttctgtcaagcccagctgctgacatattctagttgcgaggcctattatatagtaaatagcagtttgagttggggttaataatgagtactgagccacaagtactagacactggagagtcttgagatctttcggcctgataacttcttctaaaaactcaatggcggctagataataactatcagctaacccagcatacgcagagtccaatttctgtagtgaaatagagagtactattcgaacaacaaagttctgataaggatcagaacttccatcataaacatcaagtatatctctttttaaagatggctcatgtagtgtgggtgttaaatactgtgctttttgattgaagacttccagcaattcttccgtaaccgaaagactgggtaatacttgtgctggtaaagcgctaactctaggatatttctttttccgacctttgccagaatcatttcgacaacttcggcgatttcgtatatccggtacaagctctcgaattgttcttgaatcggtatattttttcgcctcttccatcacaagcctcgtcatagcaatcccactagaaggccctaaaaaacgagctgtttcatcttcggaattcaagcgtacaaatccgcctgggcgaaccatatcctcagtattagggcaggatgacaactcatcctctctgattttgcttaatcttttctctagtattctgattttc

SEQ ID NO: 440 - DNA, 1160 bp, Artificial Sequence
  Synthetic
caattcacattccatcatcgcccaatttagctttgccattccaacgcccaaccccaaatcccaaaattatccgctgcacactccaaggaccggcatgaaagggggaggggccccaaaacatcaagttctgtcaaccgtttatttttttttcgtcttgatcaattagctttgggacttaaagcaaccaaagtagctagacattcatttttcctctcattccacctcccaagccacgcccgtctacgcatcagcgttgttattttacccgattattgtctacggcgaacgtaagtcatcattgactgtgccagagttaagagtaatcatgtcgtcttttacaccatacccgcagccgcggttacaaatatatcaagacccagaccaatccgccaccatgttccaaactatgaatcagacaatgtcacaaccagcacaacttggacgcttaagagacgcatcggcgagaatcaatattatgtttaatccccctccacaaactgttaccgccacgaaatctccccaaaagacagcttggaggccttccaaatctcattcacaaacctctctcagcaataaattaaacatggtgctgattccaccacctggatctaataatgtctccaccgactccatctcaaaaaagcaaccgttgatgtcgaaatttaagccaccaaaagctttgtttgctacgaacatgccttgtcaatcacaaattgagaattttagcaccctatattccactccttttcagaacgattatatcagcgaagatatttatttggagcaaagattgtcagactcctcgaatcgcaaacgtcttttaaatgcagcacctataatagactctagatcatgcaagaagacaaagatggatgaaagtgtagtatttgaaattggtgatatggagaaaaacatagaacttccggcccctgattctttcccacctctatttgacgatggtaataaaccgcctcatagttacgctcagctgattgcaatgtccatactgagagctccagctcggcgactaacactcgcacaaatctacaaatggatctcagatactttcaagttttacagcgcaactgatgccggttggcaaaatagtattcgacataacctcagtctcaacaaggcttttgtaaagcaagaaaggccca

SEQ ID NO: 441 - DNA, 241 bp, Artificial Sequence
  Synthetic
tattagggagaggtgaaactttgccctctttgattttttgaattagttgaaaatgtgttttagcattgaaaggtggttctctagagcatagttcataaatgatgcagccaagggcccatatatcagacttaagcgtatatctttctgcagcacaaatttctggggacatatagaatggggttcctacatatgtcgatgcaaaatcgtgtgatttcattatcttagagaggccgaagtcacc

SEQ ID NO: 442 - DNA, 874 bp, Artificial Sequence
  Synthetic
ttccgaaggaatctacagattcatgcaaaagaacatcaacattggcaaaaaacaacactaacaaaaacattacttcttcaattaaaaagaacactttttccgtcatttaaaagttaattcttggaaaaatccagatttgaaattcaggtttttgatatttcatacgtcgagttccaagttcgcacttctgcacctctttcatttaactcattaagtttaaaaaaaacagaagagaaaatggcgagtaccaattacaaagaagcatttgcactgtttgataaacgtggcacccaacgagtacaattggagagtctaggtgacttgctgagagcctgtggtcagaatcctacattagctgagataaaggaattggaaaaaaatgctgggcctgaatttgattttgagaccttttccaaaatactgaatcgaccgggtggatttcgtgatccaggcgagcccggcgagtattgtcgtggatttcaagtctttgataaagaaatgactgggtttattggtgtgggacaacttcgatatatcctgacaaatttgggcgaaaaaatgagtgatgaagaggttgatgaattattgaaagcagtcaatacctcgagtggagagattaattacatagatttagtgaagactattctagcaaactgaggaaacgaaaaaggatattattaaagtgttggctctttttggttaatcatgggaataggaattcatttagtaatttacttttatacgtccaatttaggagttaatgtggaaccacgataattttatgtgatgaactaagggttaatcagtgatcagtgagtgggctgcttttgaccgagttcatttcatgaattaatataagtcgcatagttttctg

SEQ ID NO: 443 - DNA, 386 bp, Artificial Sequence
  Synthetic
cacgcggcacgaatacgtgtaattccttctctcatgatactttctcgtttctcacattgctttttgaatttagaaaatgctagcgtttctaaatctttttgttgagcttttaaatcgttgatcatggccatttgctcgtcaatttttactaaaaagtccttgacatgcctatttacattgaatacgtttctggtaaccttggtttgaatattttttgctcgatttgcataacgcaatgtattctgagtctcatcaaaatgtgcactagacggacttacgcaaacaatcattacggtcttgcaattgccaccgagagaaaactttagcagtcgagttaactttgaattccgatatggaacgtggtttttttttcggggatcacaaag

SEQ ID NO: 444 - DNA, 2264 bp, Artificial Sequence
  Synthetic
cccagcttcattagagtggtcaaagaaaccattgtaggtgtgaataggaggctgaactagagataagatggtattatgcagaatatgacaagtaggattgcattgcttatctttaataatctctctcttaattgttatcttagaagcaaagttagtttcatcatcgcttaattttaaattaataagtgaaactttgcttccataaggtgagctacaaggtgatggctgaattaaatcttcaacttttttattatcagtccttatttctaggtcatatgacctagaatcttctataaattttctaagcttatttgaagaatccttagtaggtgtttttgcaatgaaacgattattttcttcaggtaagattgtagcgacgctaaccgatgactcagtctgctctgcaataggtgtcatgaagggtagccggttttgagagatataagtaaaatctctgttaacctgagctattagctcatgctcagaggaaaatttctgtagagatataggatcaatctttgtcaaggattctagagaaatcggggtttttggtggcaagtctggtatcatacttcttttctgatctcggatattttttatttcattttgacaatccggtgaattttttttaaaggaaagttcagtccattcacttgcacttttaagatctgacgtttcttcaagatcttcatcttcactcatcgttaaaggacgtccagtcccaggactttcgcagccactagtgtagtctccatcagtcatatcgtcttcatcttcattatcagagctatcctcatcattccctcccatcttctctacagcaagtagtggttgattaaaaagatcatagatgtcatcagttgcagctttcgtatgaatagtcatagtttgctccttggattttcgtttcattatcttaggtcctactggagaagaaagcttggctttgatgatctgggtctcatttatttctctgactttcatttttcttgcccgtctttctcgacaagattctttagctaaaggcccgctaattagagatttttctactatttcttcatttaattcattacttaatgaagaatgtttacaagtcttttcggttatgtttggggattcaattgctaccatactgctacatttttctggcttccaggtttttaacagccaacctctatgtttggctctaagctcctcaatactcagctcgctcccaaatatttccggtgttggataaagttcttcaaggtgtacaaaaatggtttcccttttacccttttgatttaaagttatttgatgctgtgcaggttctgttatttgtgggtatttaaattgagattttgacaaagacatatctttgtaaacttgaattttcatactactctttccttgccctccagctttcaatgtctcgccagcccatggcttggcttcaagagtattctctttcttacgttcagcaagagatccaatgctctgccatccggccgggtcactatgagataatgagctcggttcattgttatccttgtctgaaaatatttggagtttttgcttcccatttcttgctgatggtttaaagccagtattgggtgttggtgactgattgtttcttgacgcagcaggagcaaatggatcaagtttcgccataagggcaggcctaatagaaggcaaagctggggaggaaggttggttagtatctatgggcctcttactataacgagcattgaattcatcaaatttgcgtaatagacgagctgtaggcctggcttccttgtcaacacccaggcgatatatttcttcggcttgtttccaccttcctgcacattcaagccaggcagcaaattcttcataatataaagcaaggtattctccaataccatggcgagctagaaatgcgaagacttcacggggagcatccgaaacagattttatgtatagaatccatatttttaagtagcgttgatcatttttatattgagcagaattaataaaagctttagtcgcacgttcgaggagcggtaataatttagatgaggcagtggcttgagacgaggggtaggcgtctagagtccatcgaatgtatctatcgtaaatatccaatggatcgtcagactctgacatgcaagccagttcagattcatattcttgtcgtgcaatatcattcagatttttcgagtcactgggtgttggtgctttgcttgtcgaagaaggcgaaaacacacaagccagggcgcgagcagaacgtccaccagggagctatt

SEQ ID NO: 445 - DNA, 2233 bp, Artificial Sequence
  Synthetic
cgagaagtctcttaaggttcctccatcacgataatttgtattgtcgagtttttcaaagtcaagcttgttatgggtaatgattttgttagtctaaggggctaatttattcatcaaattggaaatactcgagcgtagctgcgccgtttatacaccacttagtgtgtgcatccactgagcgctcagcgaccagagatagggaaatgatcaggcattttcaaacttgaattatacttgaccaaattctacaagcaccttattttctttcatcttttttaatgcaatatgtctgataccgacagctatgattatcttcaacctaattttgagccaacaagtcttacggtccctcgtttacgatctatcctagtaaattacaacataagctatccgtcaactgcaaaaaaagctcagcttatcaaaatcttcatcgaacaggtactaccacagagagaaaaaatcctaaaggagcgggagcgagccagaagatctagccgtggaatcgtaaacgcaaattcacgggaaagttttgatactgaagaaccaattgcactctcctcccgtccttcaagaagaaatactagaaatttaagtgcaaggttaaaagttgacgaattagaagatgaggaagtaggttacagaaaggaaaagacccgaagtccagtaaagaaaacgcccagggccagtagtaaacacgcccgggtaagtgatactgaaacagggctagatcaagacacgagaaggaagtcattgaggagcaaaaagagtgaaacaccatcacatcaccaggtagattatgtcgaagtcaaccatgagacccccgataaacttcccagagaaaaggtagaggaacaacaagatagtgcgttcacttatgataatccatttcaaagcgggagctcacctctattcggaaaaagtaatgaggcaaggagaaaaagtcaaggtatcaataaagaaagaaagaaaactttcaattccgtgaggagacgcagaacagaaacaccgcaaattactgatgagatatgtcctccaagctctacaatatttgagattcctataacttcaaatattttgagtgctcccaccgccttcgaaaaattgcatgaaaatgtaattgagactggcgaagagttcacgcctgaagaacagtcagagcttattcaggaaagatccatagttaatgaatctctgggctctttaaggaaaaaatcaaagccaataaacgggtttagctttgttgggcctttctgggtcttaatactcactacattgattggctattctatttggtatcgtcaagaaaagatagctattggctattgtggcttaggtaaatccgcaatgcctcttatttctacctcaaaggagatacccacttgggctcgtattcttatcgagccagaatgtgaaccttgccctcgtcatgcacaatgctatgagagaatggaagcaaaatgtgaacgtgattatttgctcaaacctcatccactttctcttgctggattagtccctttagctcctacttgtgagccagatggagtgaaagttcgtaactacaaagccgttgccgatcgtgcggttgaagctcttcgactgcaaaaagcaaagtttgagtgtggagcgatagacgatactggagctaccattcttagtccagaaattaacgcagatgatttgaagaaagaaatatctaaaactcgtcgaaaagatatttccgagctagaatttgagaaaatgtggactggaggaattgaggagatgaagacgcgtaacgaagtacagaccagaatagatggaaatcacctcaaactttcaagcaactcactcgctggcctccccatctcctgtgccctcaaaagatccatctgcaacacgctgggacaatatcgctttgagattggaggcttgataattattatgctctctcttttaaagttacgttcactgataatatcaaaaagaaaggtaaatgcagctatacctagccttgtctcgacaactttagagcgtctcacaaagcaagctttgctccatcaggaaaacaaaaatatcgatccttggataagtattggtcagttgcgagatgatgtacttaggaatgagcatagtatttacaagagagaaactgtgtggcgcaaagtgcgcatagtcatagagacaaacgcaaatgtgaggtcatctcaaaaagaaaatcggaatggcgaagtaagtcgtgtatgggaatggattggcg

SEQ ID NO: 446 - DNA, 1033 bp, Artificial Sequence
  Synthetic
tgacgcacaatctgacaggcatcaacctagagaacgtcaacctctagaacatggaactcctttttacatgcaatcacaatcagagcaaccgattcataattcaagccaacattctactcaagaaaatcaaaatctactaaattctcctatgtatcgaaagcctcaaaattctcttcaagagtcgaatggtagtcaaatctcttatgatccatttcccatggatggaatgactatgctctgtcggacaggaccctcattagaaaaatgtcagggtaatagctccggtccatcactagaacgaagtccagcacatagctctggtccaccatcagaaaaaagtccagctcgtagctccggtgcaagctcattttgtcgtgatattcagagtgatctaacctcactttcaagtcacgaagctattagcagcaaaactacaccaatcaaacaaagttcaccttcatcagaaagtccagtctttaaaaagaaaggtgggttcttccaaaaccatggccctttccggcgtaaaagtaacaaaggttataataattctcgtactatgacaccatcgaatcgaaatacttggtcttctagatctagagcaaacacaaatgatacttcactgaaggatcaaatatttagccaaagtacaaaaagccaggaaaacaatcgattaagtcgcagtccagatacgataaaccctatagcaaatttgcagctcaatgtagggaacaacatatttgatgtagaaacacctaagcaaagtagccgtgccattcaaagccctgaggtacgaaaagacgaagaattagatcctattgtacaggctcttgctgagctcaaaggagtaactaaagcctcatcaacccgagtttcggcagataaatatcatggaattacgacgccagctccacgggctactccactaagaaatgcagcttcgcaacagtcaaatggtgcaattacggcagcacaacgaggaactccaccaccctcttatgatttaccagttcaaaggcttggtcctcctcaacca

SEQ ID NO: 447 - DNA, 204 bp, Artificial Sequence
  Synthetic
aattccaaatttgatcccagttttgtccgtcactattggaaagagatgcttgagtgcctacaagcaatacacgcacatgatgtcgttcattcggatttaaagccgcacaattttgtcctagttcaaggccaactaaaattaattgattttggtatcgcaaatgcaatacaaactgatgagactgtgaatgtgcaccgtgagact

SEQ ID NO: 448 - DNA, 1235 bp, Artificial Sequence
  Synthetic
cgcaatagttataagaattgcgtctacaatgagaacgagactgccacaatttcttctgccttgaataactccatttgtcttagttaattttttagttgttgcttattatgatatacggaataatgtatatgtaccactgaagagaataaaactcattattacatagtcatcagaacggtttgtccctgtcccacagatagtgttcgctttccaattagccactcttgcatcgacaaatattttctagagaacgtataattctgccaactcctttttacttttggggatcggcgaaattctaatattgtccacggaactcaatctactcctagaacctctatgggcctccccataatttttaataacgtcaaataacgtaagtttttcctacttcatatcgtaattcgtttctgaaatttaatcactacttaacatactatcaactagatcgcctaaaggtccccagaagtcttttccactagcaagatgatgttcgtcaatgaaaaggatataatgcttgaaactcgtattaagatgcgcctcaagtccaagttctcggataactggataatgatgacaataaatatgagcatatactcggtacattctcttaaaaacttgtcggataatacttggaaacgattttgggaaaggaactccagttttacttggaaatatagcttcattatcgatactactctggacccatcccattaagtgttcaatgtacgtaggggcagccatcttagtcggtcgtttgaaattttcagggtcttgccaaagatattcatactcatcagtcgctttcatctcaggacaggattgcggcgagcagaattctgttatcgacccgtacagtaaattaatatggttgtaaaaatcaaccaagttgacagcaagccattcattttcatcttcaccttcgggtaaccttactatctttcgaaggctaccccctccgagagttgcctctgcatactgtcgaagttgaaagctagtagttcccttcggcgtatttcgagtgcgaaattggtttcgagtgcgctgatttattgttggaatgaaggaagtcattatatgaacaatgtgatttcaatttgaattctagttctatcatccaaaattagaataatgagtgatagaatcgagtgaattagtccgtatttgttaagagctgatgataaatttaatgttttagaagccagtgacatcgattataagaaatgtaaaccgaa

SEQ ID NO: 449 - DNA, 1938 bp, Artificial Sequence
  Synthetic
tgaaattccacttgtcagattcatgtttacaaggactggcacagtggaactttacgacattaaattccagtaatatttactttactcattcaatctactatatacggcattattatttgaattatcgaagactttctttatgcaacagtaaatctgctatagacaatctctattaagcctccaggctaagagccatcatgaggagctggctatatgtaattgcatgcttatggttatctgtaggagcaattcagatcaaattagatcagacaaacgaaaaccgacaaatatgtgctgggatgtacagtcaaaaagcctggggaggcagtgtcgaaccttacattcttgtgaatttcactaaaaacgaaactggtgataatccagatccaatcgttagcttggttatatttgagtggaaagattatgacttaataggagttttccccactcctgactctgatattaaagaatacatgtgcgataaggagactatcaaattaaactattgtatgagtaaccaaactggagagtttatcatggctccgaacgccactaaactctctaagaacttgctttatacacaagccgtacatcttaaagaccctggagttccaacaaagtacgggattaaaaaaacaggttactattgcgttggggctacagcttttcagcccagggatttgatttttggagcgaccgtagactttcgaaatgcatatggacagttaccagggtctcaaattgccaaacttccattctatggaggtatcaccattgcctatgtagttgttggagcattctgggcctttctttatgtacagcatcgacatgatattcttcctgtacaaaactatataacagcaatcattatatttttaatagtggagatgttaatgacgtggggcttctatgattatatgaatcggactggctctagcattggctccaaagttttaatggtgatagtagcaatcttaaatgcaggtcggaattctttctcatttttcctgctactaattgtgtgcatgggttatggcgtggtgaaagaaagtttgggcaaaactatggtctacgtccgatggcttgcaggagctcatttttttttcagtctgatatatgctgttatcagcttaacaattgctcctgagaatgcagggcctcttgtgttgttgattattttaccccttgcaggaacattaacaatgttctacgtctggactctgaactctctaaactatactatgagggaccttgcccatcgtaaacaaaatgttaaggcattaatgtaccgaagactttggtgggcgattcttggctcaattattgtaatttttggctttttcttttttaattccttcacatttgcttcgcgaggcgacccagactttgtaccatttcactggaaaacgcgttggtttatattggatggatggctcaaccttgtatatttcgcagatgttatttttattgcttatttgtggcgacctaccgaaaataatcgaagattcgcaatgagtgatgagttagcacaggacgatgaaggttttgaaatatccgactttggagttgaagacgatgaaatagagtctactataggccaaaaagaagatagagatcaaaggccagaagagacgaggtacaatcctgcgccgaaaaattccggacgaaagactgtaaaaaatacaacacgtgagagcttagaaagagaaacgatatttactgttggtgaagacggggacaaatggtcaaataatgatagtgacgaggagcatgttaatctcgttagtgggtcaaacaagccttcttagatttacgacaattttttttcaggaagaatagctgtatttttagggaatttgctacacacataatgttttatacgataatatttagcgctgggaatttcgatgtattctaatcttgcatattttggggaga

SEQ ID NO: 450 - DNA, 2585 bp, Artificial Sequence
  Synthetic
ccaccatggccagtcaaagatcaattgttggtaccgttatggcggctgcattacttgagtggtttttgtggctcgcagcttttgtgtactgcctgatcaaagtctaccaaaaagctgagcattggtcggtaaaagtgttggcacttattgttgcaattatttttacagctctcagactcatatttctcccgattatgatcacgacacttcccttaccaacacatatcacccaatactttcctctccagttggtatctttcttgcaatggttcggattttggtcttttgctgtattattaacaataccttggttgttttgcgtctatcaattagtaacacaccaccttggaagaacgaaacgaattaaagaagtgcttgatgaacattctgctcctaaagttgtgattgtaatgccatgctataaagaagaacctgatgttcttgtaactgccatcaactccgtcgttgattgcgattaccccccttcttgtattcatgtttttctttcatttgatggagatcaagaggatgagctatatctcaacacaattgagaagctaggcgttccactatcgctggattcttacccaaaaagtatcgatgtcacctaccgatcagctcgaattacagtgtctcgatttcctcatggcggcaaacggcaatgtcaaaaggctacatttaaacttattgatagagtatacactgaatatctcaaaagaaatgataatctttttatactttttatcgattctgactgtattctggacagagtctgtctgcaaaattttgtctatgatatggaattaagtccgggtaatactcgggacatgttggcgatgactggagtaatcacatctacaactaaaaaacacagcctgattacattactccaagacatggaatatgtacatgggcagctttttgagaggacggttgaatcgggttgcggagcagtaacctgcctaccaggagcgctaacgatgcttagattttcggccttccgtcgtatggcaaaatattattttgctgataaagctgagcagtgtgaagatttgttcgactatggcaaatgtcatcttggtgaagatcggtggctcactcatctatttatgattggtgctaagaaacgatatcaaattcaaatgtgtacttctgcgttctgtaagactgaagctgtgcaaacttacacaacacttgtcaagcagcggcggcgctggtttcttggatttatcacaaatgaggtttgcatgttaactgatataagaatttggaagagatatcctattcttgtccttgtgaggttcatgcaaaatactattagaacaactgcccttctcttttttataatgttagtagcaatagcaagtacttcaatgagggtcaaggatttgccagttggcttcattggtatttcattgggcctcaactggctaatgatgatatactttggcttcaaacttaaaagatacaaagtttggctttatccattaatgtttctgattaatcccttcttcaattactggtatatggtgtatggaatttttacaagtggtcaaagaacttggggggggcccagggctgatgcaggacaggctgatgctaatacgactccacaacaagcgatagcaaaagcggaagcaactggagatgacctcaacgtggtaccggaaactttcaagcaagcaaatgatggacaacgacaagctactcgtcctggaatgcatctgcaacctcccgatcgaatacaaggtcgctttgctgctcctgaaatgttaccaggtggctggtatgaacaaggaaatgattcggttatcagctcttcacccgcgggcgcgctgggagttagcagaccaccaatgtatcatagggattcatttgacagtaacttttctgccggaacaacaacctctgtttacttaccaagacgggttgagagtattatgggtgaagaagatagaaaaaagtacgctatagctcaagcgaatcaagtaaggactaacccaaatccgattgggtcatattatccatacggacaagtatatgagatatcagagaatgatataaataacgggacatataaagattcagttgagtcccttcaatcagattcatatggttaccatagatcacactcggccaatagtgtgaggtcgcttgaaccgtatggggaggtaggagaggatcttttgtctcctgtgagctcatctaatcttcccataccgccatcagctgcctctagtcatagtaagaaaagtggtcgaagtcccttggcgaggcaaagtctagtgcgaaccgtacaagatgaaaatgtgatcgaacttgaatatcaaccagaaattcggacagatagatcacctgcctcaccttactttccaggaaaaaatggccactcacagcgatgacacaggtttttcctcaataattaaggcgcttaaagaaaaaatgattaagatggaagtaattctttgatacttcaactttgatttcaccaaaatttgttctctttgttcttgcatagctaggcgttcagttgaggtagggagaagctaatttttttaatttgggagaaaattattattggggtg

SEQ ID NO: 451 - DNA, 1971 bp, Artificial Sequence
  Synthetic
gcggtatgataatttccaaccatcagtacaaaagaagtgagtatatgaaagtagtccaagtatccattaagaatacatttcaatagaaggtatgtactcgatttcaatagaacattcttttaaacttcaacaaaaacaatagaattatgatggcaataagcccttacactttaaatttagctgctatattggtaatagagcttttaaagtaggcattttacacaatctgtcacgtattgctctttttccaacttcgaataatttatatgaatatggttcgccttggaacaaagtgttacattcttgaaactcaaaaaaatccaagttcataccagatattacttctaaatataaattccagcagacgcccatacgcctctaaacgccaaattaccgcaattttacggcaaaagtatgtacaattgataatgaggtggtaaagtaatttaataactcatcaaacctctaaagttaaaatattcgaaatcttagaatggataaaaaattgttagataagtcattattaggtgggcctatcgcttgggttctcgtgattgttcggcacgttctttttctagtgctgcttgtctttctgcttcttctttggctttcttttcctcggcgatccgtctttcttccgcagcttgccaatcggagactcttcgctttgcttcttcaagttcattatgctctcgctcttgtctctcattatcaattcgttccttttctcgtgcctcttcttcttgtgttcgctttttatcttcttcttctttcttagcgatcaagcgtttctgctctgcctcgggtaaggtggagaatgcagcagtatcagcatcccatttatcaacacattctcgcttccaattgcatgcctctacttctccgtaggctggatgattatgacgtggatgagctttaggccagcccgaggcatggtaatgatgcttcacaagagccgtctttgcttcatgagtgccagagtcagaatgaccttggccagcggcaaatgcttctaccgtgagaacaaggacaccaccaacaagtttggtttcaatcatatcatgaaatgtttcccattgaatgtttctacctgttcttttacgcatatcagccaatatggcattggtaaaagccgagggaccagttccagtaattacttcatcgaaatcgagcaccagctcagagattggcaatttttgctttcgggaaagctgattgagccagacgataatattatcaattaattgcatcatcaccggtagacgtggcttgcacataaatgtccattggcaaaatgatttagatttaggaccaagaatagggtgatcggaataatgcggcatatcaatctcgacccctacaatcatatcaatgtctttctcgttccatcgctctggaataaaacgttcaattggacgtaaagcttcgacatcaatgtcagcgtatagacctccttccacatacataatcaaataacgaaggaggtcagctttaataatctttgcattaagagttctgtatgtatggacaatgtcctgtcgatttaagcctgcaggaccaaaatgatgttcaacataatccatgtcattcccgtccgtgagcatttcatatctatagccaggattttttgacgtccagcttcgagctcggtgtaattccttctcttctaattgtagaacatcaactttccatgactgccatattttcttcggaaattttgttccagtgacagcgaatggattgtattgccattcacgccgaataacttcccccacgcgtagagaaggaccaaaagagtgtagagtagtaatgaccaaaagtaaaaggatgcaagccaggtaaattggaggaaagcggcgaacaggtaaggatcttctgatacatttgaccagagagccactgtattgagccacggtgactagcattctgacgattaaagtaggtgaacaaatctcggaagcaacaaacaag

SEQ ID NO: 452 - DNA, 1949 bp, Artificial Sequence
  Synthetic
atgatatagtgtgaaactaaatcgtgtcgttaccagatcgactgaaaaatttgaagtccttttgaacatccagggttggcaaaaagccataaaaaatgaatgatggatgaatctactattaaaaatttaatcccatctttgcttcctgaagcacctaaaaattgtgaaaatttgccaaattcttctgattcagcggatgaaagaactactttgctacccccgacattgtcttcagccaagctatcgaaaggcaaagatgaatttttgtcccttctttttgaagttagcctcttattacgaggctctattcctgtggttctagcctatgccttgcaaaattcgctgcaaactatttctgtcttgattgtagggagactaagtccagaggctttggcaaccgcttcatttagttatatgtttgctatgtccacggcatggttgattgcgttaggtggatcaacggcattagatacactcgcatcatcgacatttactgggagcaaaaattcccatcatcttggtgtacttcttcagcgagctattatcgtcttaactgtgttttatataccggttgcggtcctctggtttttttctgcgcccatctttcaaatacttggccaagaagaatatatatctgtaaatagttccaagtttttatctgctctgataccaggaggtcttggatatatttattttgaaacgatgaaaaagtaccttcaagcacaagaaattatgcatgcggggacttatgtacttattttaacctcacccatctcagcatgtcttaattatatctttgtacatactcttggttttggcctccttggtgcacccatagctacaggcattgcttattggctctcttttgcacttctagttctctacacacgttttttcacccattctaattgctggggtggatggtcccgtagttgcttaataaacattgcaacattttctcgactagctatacttggagtggttcatattggaactgagtggtgggcctttgaaattgtggctctagctgctggacggctgggaactatctcattggccgcgcaaagtgttatcatgacaacggaccaggtcatgaatacaattccttttgggatcggtgtagcagcaagttcccgagttgggaacttgcttggtgctcgaaatgcagttggtgctgctagagctgcaaacgcagcagcttggctgagcatattaatgggtgctatagttctttgtatcttaatgctggtcaagaacttttatgcaaagattttcaatgatgatgttgctgttatcaagctcactgcagaagtgataccatgggtagcccttttccagattgcggatggccttaatgggagctgtgggggtagcttacgaggtatgggccgacaacatataggcgcgattgtcaatattgttagttattatatgggtgctcttcctcttggtatttggcttgcattccacggctggggcctttcggggctatggattgggcaatgcattgctctttatttggtggggatttgtgaatggataattgtctctttaagtgattgggaaaggcaggtaaagatggcttttgaacgaatggatagtcccgaagtattacaagaagaagcacaaaatttatggaacgaagtataacgaaattttgacattttacgtccaaaggacgcgtaaccaaaaggataaaaaaactgagttggcaattatatgtacgtcgcaaagaaactctaatatcaatatgcaacaatcacaatctctttccgagtatccacaaaacgcttcaaatttagcacttcaaacttatcattagatgatacactcatgattttggtggaggggggggtggttctttttttttggggatttatattccaagttaaaattttctttgaaatggaaattattatatttctaagagatactgttagatagccagc

SEQ ID NO: 453 - DNA, 1728 bp, Artificial Sequence
  Synthetic
aatctcttgactgatcgggcatttttcaagtattatctcgcttagctttgtatttacaccaacggacaatccaatgtttcctatgccatgtgagaatcaccagaaatatagcttggctaatgagggctgcggcaaggtgagctcttcaattattcatgtgtgttcgcatgccgattaaggaagagcgtttgatttcattctgaaattcctttgccagccaagctggtttagaaatacctaataataacatgtgagaaaatgaagtgaatcatctacgcaatatcagttctgcctacgaacagcgcttgacccgaaattaaataagaaattgcaattcctacacccttcttagtctaattttgttgctatttagatacacactgtcaaccctcaaaaggaccactagaatcgagcatgagttgcagcttgaatattcgagtatgggaacagatcaaattgtctcagagtctgatctaactaaaataaatgagataaccctctaagaagagatggacaatatgggattatcacagtgtggaattggtgtgacgggcaattatgacactttggtgcatttttatgccttaattttcattttaattctcagcacgttggcatgcgggcttccacttctgtcaaaaatagccttcaaaaaatgtagaactgggaatttactgtttctttcacttcattttggcacgggagtgcttattgccactgctttcgtacacctgctacctatggcattcatgtctctcactaatccatgcctagcttccttctttaatatgaagtacactcctttagctggcttgatttcaatgatttcaacactgattatcgttggcttagaaatgtatttaacaacacgaggagccagaggttcacactcacatgaaggacccgtaagcaaatcacccttaggaaattcctacaccaaaaattttgatacatctcggagagctttaaatgaaaattctcttggacttcctttgcaccaaagaagaaattctctacaagatactgatgcttctgaagcattgctagaaactgcgtctgcattttcaatatctaccccagtgtttgctcaacccacatctggctcttttcaaccgtgcgaatatgagaacatgtatccttatgaatcaatggattcttctgttaacttatcatcgcccaaagccatacaaatggatgaggtatctatcgatagccttcccatttcacctgaagatcatcaaaagcatcaaatcttacaatgtattatgcttgaagccggtatcctatttcatagtatttttattggcatagctctctcagtagccacaggtccctcgttctttgtgattcttgccgccattggattccatcaatcgtttgaaggcttagctcttggttccagaatagctgctattagattctcaacacgatcaatcaggccatggtttatggtcttagcatacggtatcacgactcctattgggcaaggtataggtataataatgcataatatatacgatccccaaagtgtagcagggcttttaatagttggcataatgaacggaatctccagtgggttattactttatgcgggtcttgtacaacttttagcaaaggactttctgagtcatcaaagttaccatttactaaagggaaagcaaagagtaaaggctttttgttctgttgttgctggtgcatcatcaatggctttaattggagcttgggcga

SEQ ID NO: 454 - DNA, 2910 bp, Artificial Sequence
  Synthetic
tttgcctgttgcagctggcacttgtctactgctctgcattgcttcaaaggaagtttgacctaatcaagatgtcggatcaaccgactgaaaacatcccaaatacaaccgtgtcagcgctactggcaactctcataccaacagcaataacttctgctgtctacttagggatatttttggtcctacggagatcgcaaaatcgattttatgccccaagaacatacttgggaacactacgagaggatgaacggactgaaccgttacccaatggatggcttgattggatttcctccttcactaaaataccagattatgcagctcttaaaagtcaatctcttgatgcctatctgtttctccgatttctcaaaataacagtagtcgttatgtttgtaggtgttttaataacatggcctattttattcccagtgtatataactggtggcttccatagtggccagctagatatgctttccatgagtaacattaacaagtcgggaagcggcaaacatcgatattatgcaacgacttttgttgcctggatatttttttcatttgtactttatctcgtcactcgagaaagtatatttttcataaatatcaggcaagcctttctcctctcgccattaaatactcataaaatatccgcacgtacagttctcttcacttcggtacctgctaaatacagagatgaatctaaattacgtcagatatttggctcatgcgtgaaaaaggtttggataacaaaagacagttcagaggttgacgaccttgtatctgagcgcgacgatctcctactaagattagaatcatctgaagttaagcttattaaaattgcaaatacagagagactcaagattaacaagaaaaaagctggagataataactcatcatctgaagtcgcagctcctgtcccagcatctctagttgactactgggttccagaaaataagcgtccgactcataagcttggcttatttgggctagttggacagaaagttgatacgattaaatggtgtcgaaatcgtctggagtcccttattccagctgccaaggctgcacagactgcgtacaaatcggaagaagctaataaaactggaagtgtattcatcgagttcaaccttcagtctgaagcacaagctgcctttcagtccttatcccatcatcaggctctccaaatgagtcctaagtttattggcattaatccaaacgaagtaatttggtcgtccttaaagttgtcatggtcggaaagaatagttcgcaaaatagccgtaattggaatcatttcaggtttaataatattctgggctatacctgtcggattcgttggacttgtctcgaatgttaactacctaaaaacttattctgcgctgtcatggcttgatcagatccctgacgtcattatgggaatcatcactggacttttgcctgcagttgcccttgcattgttaatgtctttagtgcctataattattagagtattgggcaaaatagctggcgagccatccttagctcgagtagaactattcacccaaaacgcctattttgccttccaggttatccaggtttttattgttgcaacagtggcttcggctgcaactgcacttgtcaaacaagccatagatcaccctgagagtattaccactacattggcgactaagattcctaaagcatctaacttttatatctcgtacttcatcgtacaaggattgactgtcgcttcaggggttatttcacaggtcgttggttttttagtattttcaatactgtacaaatacttttctggaacgccgcgtgctttgtatgaaaaatgggctaccctaagttctgtatcttggggaagtgtaatgcctgtgctcactaatgttgcagtcatcggaataacatattcctgcattgcgcctttgattctaggctttgccacaatcggaatgtcattattttatttggcatatcgttacaatattctctttgtgaccgacttcaatgttgatactaagggtttaatttatcctcgagcactccaacaccttctgacaggtatttatcttgctgaagcctgcttaattggactattttctatctccgcggccatcggaccaattgtattaatgtctttattccttatattcactattctctatcataaatctctaaacgctgcaattgatccgctaatacataatcttcccaaaaccctattgacgaaagaggaggcgaatcttgcgcaatcatatgccgctgaggcagggactgtacctccgactggagaatctaaacccaaagttgagccttctgttgaaaataagccaagtcttctttcaaagttcctcaacccacacatacactcaaattatgagcattttcgtcagatttttcctcagtgtgatctagatcctcgatatctgtatgatcaagttgtggctgatgaggcatatttaccgctatctgtcaagtcacagccgattcttttatggataccaaaagacaccataggaatctctgatgaagaagtggctattattgataaaataacaccaataactaatgatggagctacgataagtgacgataataagatagagtggaatccagaaggatcgcgccctcctatatggcgaccaaaggttttgtattaaatacaaaggcaacagtctaggttaagtgatgtaatgactgaaatcaatttttcagcaactaaactataatttaaatttagtggagattaatatgaggtttgcgtgtgggctatacattcactttcagtatccgccactctactgtcttggaaaaaaagatacccatgattttgattttaggataatgcataatgtattttggtatttattaaaaattattaagatgagttacttgtgtcattaagaaatgctcattgttggattttttcgagttttc

SEQ ID NO: 455 - DNA, 1107 bp, Artificial Sequence
  Synthetic
caaaccctaactgccacaaataaatatcttacctacgtccggaatttaacgtcaacgtcaacgtcaacgtttgtcattctctacatcactaacaaaacagcaaatcaactaaaatgcctccaaaatccggaaagaaggcggctcccgctccatttcctcagtccaaagctgggtctaaaaagacaacgaagaatcccctacttgaaagacgatctcgcaacttcggcatcggtcaaaatattcagcccaggagaaacctctctcgtatggttaagtggccagagtatattcgtctacagcgtcaaaaaaaaattcttaacctacgacttaaagttcctcccgcaatagcacaattccaaaacgttctagatcgaaacactgctgctaaggcattttctctcctcaataaataccgtcctgaaagtaaaggtgaaaagaaagagcgtcttctcaaggaagctacagctattaaaaatggcaacaaggaggatgtcagtaagaagccatacacagtaaagtatggactcaatcatgtcgttggtttggttgagaataagaaagcttctctagtcttaatacccaatgatgtcgatcctatagagttggttatatttcttccagctctttgtcgaaagatgggagttccttatgctatcattaaaggaaaagctagacttggtactgttgtacacaagaaaactgctgctgtattggcaataactgaagttcgatccgaagataaatcagagctatcaaaattaatccaagctattaaagaaggctactctgagaaatatgaagaagctaagcgtcactggggcggtggaataatgggggctaaagctaatgttcgtatggaaaagaaacaaaaagcacttgaagctgcaataaaaatataatttcaaaaatggccaatgctctctatctcataaattgtggtctttaattagtgatagctcactgattaattcaatttttacatggaaaggaaacatttaatttgccgctaactactagtatgtggaagaggcagaaactgtaattaaccctttgaatcgaactttgaacattaactaatgtaccttcgtgatcaaaactgaatatgat

SEQ ID NO: 456 - DNA, 874 bp, Artificial Sequence
  Synthetic
ataggatcgtcatgtaacttaattcattttcctgttgccaatttacagggtaagctgaactctcctgttcttctctctcagcatgaaagcctttgagggattctatgaaaatcagtcgcaaatgctatatatatcccgactaaaataaaaagtccctctttccgatgttaacaccttcttttcgcaatagagcatatgcagtgactaagtggaaatagaagtttggagtgatccattctagtataaaacttttaccggtatgtttcaaaaagtagcccttgactgtaaagcttaagtcatcttcttcacttccaaaatcactctctttcacagactccaagatctcaattgttttctttacacgttcttgtaattcctcatatgttttctcattgttttcgtattcaattggtgtgatctttccgagacgctcagcgacaaatcttgctgcatcagtaactttttggatctgaaaggtgaagttttccatatccgcaatcagacgggtatttaccagctggtcattagagacagcttcatgagctgctcctttctccattatcttagagagtgatttgagttttttagtgaaaaccggtatgcttatttcgtacagtgaaggcattttcaaaagtggtgacaataattggatttttctagatgtgtaggtagaaagcagatgtatggtttggacagcatagttaattgggatttgcgtgggctctaatactgtactctgccccgattattcttgaattttgcagctgccagttttatttgaagaatccttggtatttccaaatcaagcggatctaaaataattcgattcacaaactcctttcctactttccactctcactaggagttgtcaaaa

SEQ ID NO: 457-471 - skipped (15 entries)

SEQ ID NO: 472 - DNA, 1156 bp, Artificial Sequence
  Synthetic
tcttgttgcaaccactactgcacgcggttgatggcttctcctctttcatagtatcttctttcttgttgcaaccactactgcacgcggttgatggcttctcctctttcatagtatcttctttcttgttgcaaccactactgcacccagttattggcttctcatctgcaggaataatagtaggggttaaagaggccttagcgttgttttctttcttatcacacccactgttgcactcagtcaatgtatttgcactatttacgcttttctggtcaccacaactcttgttcatattccttttttttacttcactatttatttcttcttgcatagaatcgtcgcattcactttcaacatcttgattttgcgcaacatcgccatcctccatagtctcattattttctgcactgactaagtcatcatcgccagtctcatttgcgaaactaggatcgctgtcttcttctgcgacttcagaattcagctcagagtcagccattctttttttgacaatattgtattcctctaaatacttttcatttctacccaccaagttgctgttttgactttcaacacacggaaaatcttcagaagaatgtacatcagctaatgaagagctttctgagccttttaaatctttacacagttgagtcgcagatgcagaataacccaggacgaccagcgagactaaactgaggcgcattttgcaaatgggggaaattattgatcagtgctgtgataggtgattataacgagagagaatacacggtaaagacagtagtatggcatatgatgcaaaatgtagaaaagattgtaattgagttggcagtaagttcattcacgaaaaatgaattattttccacaccatatccgggctgaggaaggaagacatttgttttcaagtcaagttaatgaaaaaaccaaaaataaaactcaaacacacagtgagtaatttttattaaggtggtccaataataattttttctgacatgtactccttgtagttttgagatgaaaatagagataatattgagtctgtcgttatccgaaacagtttatgttagaggttgataaatgacgatacaaaatgtatatattaggaaatcaatttaccgtgaccaatgagaaaagaggaggtctaattgcgatcttggtaagatat

SEQ ID NO: 473 - DNA, 1349 bp, Artificial Sequence
  Synthetic
gatacatgaaagaaaaaaaaatggaaatgatcacggatcatacttataagccatatttaatcatcagctagcccttagggttgatctatcctccctcatttccaacacggctctctcataatagttcgattggcctaattcgtttgatgtatagttgagatcttataactgtccaaccactaactcatcctctctcaccctttgcgtataaaatgtggaaatgaaaaatagattccaattccaataacctatctaagtgattccaaaaaaaaaacaaaaaaaaaagaatatcaaatcaagtgattgattttcgtgatcttcccgtcactttgtcagtcaatatcccgggccccaatctaaaaaaattcgttgcggcgtaagtgaaatatcttcgagagcataatatttttataaatttatagagagaaagtggcgctggaggccaaaaagtctattccatgaaatgtttggtccaatgagaatatatccaagacatcaagtccacttcgatttgtaaagcaagaagttatgagaccttgagaatgactgaggtaggccgaataagattttcagattctaaaatactggattttggtaccaattcatgatcctttctggcccccttacattggcgacaaggcagatagtcatcgagttggtcttttccagtcaaagaatgataatctccaacgtctttccgggaaacagaagttgtattgacattaattacagctgtggatgaggatgaacgataatattggcgttgagctacagggaagggattcaacagatgccattgccattcataatttccatgaagccaagtcgttgaagccagagatgcaagtgtatggaagaatcccaagagccaattgattgaagacagaattacttggcgagattgagtcgcagttactttactttgtggtcttatatctttatccactcgggaatttccatatttgatttggagcgaagagcgcgttcgaaacgaattcacaagaagttttggcattttcctattttcttttttttttctatcttttttttttttctcctgatatttacttttttttattttttattttttccaaatgacaacgttcagttcagtagtatttcctcgacggcttgtggtctagatttgcgctgatttgcttcgtgatacagtgaagtggtggtattcagcgtaagccttgaaagagagagtcttgggaaaagaaacaaacttgggaaagaaatgaggtgcaggtgagacaaactttatgttggctatttattgaccttggcttacttccctcatgcctaattcttttcctctcctctctcatccctcatccacttggggc

SEQ ID NO: 474 - DNA, 1062 bp, Artificial Sequence
  Synthetic
tttttttgttttattcttttattctttttttattttttttttatttttattattatttttcccttccttcctgccttttcgcatgggcacctgctatgctggtgcgaccgggatccgatctgctgctctatttggcaggagtccaatgctgatctcctgcctgaaaaggtcagcctccgagaggaaagcggcaggggctgcaaggctctgtccggattaagggggcttctcagctggctgcaaaaacctataatacagctgccatctcgctctcctccatcattcaaacactcacgatcattccacattcttttgatcctaacctgatctctgttcattacattcctctgcatttcgcctttttttttataaactattcttaatactctctcaagatgcagttcaacgtttttgctctctttgctttcatcgtttcagttgttatggctactgagactgtaactgttactgtttgtgctccttcagctacatatgtaccatcccaaggatacgccgcccctacagcacctgcctatgctcctattgcatctggttcacccgctgtcaatatgccaggcgctccttctggaggatacgccccacctgctcaatcacctgttccattcactggttctgcctcttctcacggcgtctccagtctttctgcacttattgttgctggaattgttgcactggccatgtaaagcagtttatgactcgtctaaatatttaattacggctatgcacggagagcttggggttactgtttttttttctcaaaaatatgccggtgggattcgaattggtccggatattttttctgtaaataattgagtgacggctttgtactcgtgataattacagacaaatctaatataatgtgcttatccttctaacgaacttcggagaatgatttgttttattgagtgattagttgacttgttttattagttatggttatcaaacgatcacataaaaaaacgcatactttttacaatgaagtgattgtataccaatgtttcccttggtggccctcaaaaaactaagttagatagatgcccc

SEQ ID NO: 475 - DNA, 2236 bp, Artificial Sequence
  Synthetic
agccctagtaaattaggtaacgtgacgaggaatgaccctagttaaaagtctttgccgcccattattagcgagaaatccttgctttaagtccagtgaaaactttggatcaaaacaaagcactcatgtaaaggctctttgcatttagtgagaccccataggagctaatctacattacacgaagaataacaatactgaattagatcaatccgattccaaaaaacttcgaacaaggcttctttatttttaataattgaggtacttcataatgtgcaacatttttttccaccaacatatttagccaataattatgtcaaccaaatattttcagtcgtattgagaaaattcttgtccatgtgcaagaagattaaatgtgggtatctatcatgtcatactgaatgaagtagtaataaaaattttcagactcatctcacatttcgaattcaactagtcattcagtcatttattgaggtattttaataatttatgaaatcatagttcatagaactacaaattctacattcaatatccttggtagcccattggcggtctctgaccttgcagtggtgggttatatttattcatttgcgatcttcctccaggtattggtgaaccaaatcgattttgattgtatggattagctgaacgcccattttcttggtatggagcttgcataggagatgagcggccattatctgggtatggagcttgtgtaggagttaagcggccattacctgggtatggagcttgcataggtgatgagcgaccattacctgggtatggggccagcataggtgacgagcgaccattacctgggtatggggcctgcataggtgatgagcgaccactttcttggtatgcagcttgcatgggagatgagcgaccactttcttgatatggagctcgcataggagttgatctaatgccctcattatatggacgctggccaggaatcccataacctataccattgagacttgaagatgagccaccaaatcttgcaccattttctattgatgggttagaagagtattggtctataagattctcattagatctgtttaggttagaggtgttaggatttatataactattattgttatttggagactgtcttgttttaaacggagcaagaacattttcctggcctagcggtgagcttgtgcctgtgacagctgcagctgtaacaagaggggtcttttgacctattgaagagttcatttgttccaattccacactttcactgtcttccgcttcatctaacacatgcacactagtggctgtatcccagcttggcattgctggtagggaatcttcgttcacaggtctagatttcgctttgtagatcgaaaaacgtgcagattgagaattattgattccacctttcatcatcggtgggggggcactgtatccctgatttctatagtctgatgaagaatgatttttgtaggcaatagactttcttctcttcccagaacagcagcttctacagcatccacaacagcttaggaaagagaagcaagaacaacaaaatgagtatccaaagcacaagcagcgtgtcatacaaatgataattgagaggactattaagccaccgataacaagtccgattattgctggccatttgcaataaatttgtatcatgcatttatcccagttggtgaatgaagaagtaacgtttgatacttgattagttaattgatcactcaactgatcacttacaagccttggcctaagcaaactaatctccaaaaaattcatgtttccaatattaacacctccgtgatcttcattaaataagtaaggcattttagcagttttgattaacttctactgctaaaagcttctccttctacatgccaaatcaacttaactccttgcctcacaactaagtcttgattcagttctcgaatttaaatagtagaatttatttaatatattagttgactatctgtcaccaacaggcgatttaatccaactatttattcgtctgtcaaaacaagttacaagatctgatccggttatgtctgattggagatgagacgctctttacagcttgctaattcagaatcgtagtaatttataaatcttaaaggacagttctgtgtaagacataaaagagtgaacgggaggataattgtaaaaattcaataaagagggataagttatatggtttcaatctacttggagggtctcagcgccccacttgtctgccttctgtaaaattagagcagactta

SEQ ID NO: 476 - DNA, 449 bp, Artificial Sequence; identical to SEQ ID NO: 109
  Synthetic

SEQ ID NO: 477 - DNA, 598 bp, Artificial Sequence; identical to SEQ ID NO: 192
  Synthetic

SEQ ID NO: 478 - DNA, 598 bp, Artificial Sequence; identical to SEQ ID NO: 192
  Synthetic

SEQ ID NO: 479 - DNA, 598 bp, Artificial Sequence; identical to SEQ ID NO: 192
  Synthetic

SEQ ID NO: 480 - skipped

SEQ ID NO: 481 - DNA, 597 bp, Artificial Sequence; identical to SEQ ID NO: 139
  Synthetic

SEQ ID NO: 482 - DNA, 597 bp, Artificial Sequence; identical to SEQ ID NO: 139
  Synthetic

SEQ ID NO: 483-484 - skipped (2 entries)

SEQ ID NO: 485 - DNA, 594 bp, Artificial Sequence; identical to SEQ ID NO: 195
  Synthetic

SEQ ID NO: 486 - DNA, 594 bp, Artificial Sequence; identical to SEQ ID NO: 195
  Synthetic

SEQ ID NO: 487 - skipped

SEQ ID NO: 488 - DNA, 594 bp, Artificial Sequence; identical to SEQ ID NO: 195
  Synthetic

SEQ ID NO: 489 - DNA, 568 bp, Artificial Sequence; identical to SEQ ID NO: 191
  Synthetic

SEQ ID NO: 490 - DNA, 568 bp, Artificial Sequence; identical to SEQ ID NO: 191
  Synthetic

SEQ ID NO: 491 - DNA, 568 bp, Artificial Sequence; identical to SEQ ID NO: 191
  Synthetic

SEQ ID NO: 492 - DNA, 568 bp, Artificial Sequence; identical to SEQ ID NO: 191
  Synthetic

SEQ ID NO: 493 - DNA, 483 bp, Artificial Sequence; identical to SEQ ID NO: 168
  Synthetic

SEQ ID NO: 494 - DNA, 483 bp, Artificial Sequence; identical to SEQ ID NO: 168
  Synthetic

SEQ ID NO: 495 - DNA, 483 bp, Artificial Sequence; identical to SEQ ID NO: 168
  Synthetic

SEQ ID NO: 496 - DNA, 483 bp, Artificial Sequence; identical to SEQ ID NO: 168
  Synthetic

SEQ ID NO: 497 - DNA, 456 bp, Artificial Sequence; identical to SEQ ID NO: 213
  Synthetic

SEQ ID NO: 498 - DNA, 456 bp, Artificial Sequence; identical to SEQ ID NO: 213
  Synthetic

SEQ ID NO: 499 - DNA, 1254 bp, Artificial Sequence
  Synthetic
cgtcaacaacccccctcctcttccccttccccttcattgaacctcgctccaagggggctttatgggaatctgcctcgtagtataaagttctgcagctggctctacggattgcatctacaacaactacaacatcatcatcatcatcatcttcatcttcatcttctccaccttcataagcttctacgtttttgcatgttcaattgactccactggcttgtttgagctcaaagacccggggtccgtcacttatctgaaattaattctactcagccagttctgaagatcctgtcaatcgtgtggtatagattaccaacctttaaaacttaagaatcctcaaaagtttgcctttccaaatatccatcatgcagctttgtaacgtacctctcgtcctgtttggtctcctctgctttggactagtttcaactgctccagcaccaaactcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacaggtacaggtggttacgcatcgccaacagggaccagttaccctacacctactggaggttactctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatgttgtgtacattcatagactgaatttcttttttattatttttttccaaatacactcttcctggaaaaagaagccctggaagtggtattattctctcttattattctcttctaccgattagtctaaatgtggtggctactgaaatacgattcattctagaaaattttttgagctgagatctggctctgcagatttaattgacggtcagctaagatgcactctgttttttgatattttaatgtacatatagacacttttacatatattatatagtttcaagaataaagtcagattaaaatccaaaccgc

SEQ ID NO: 500 - DNA, 1254 bp, Artificial Sequence; identical to SEQ ID NO: 499
  Synthetic

SEQ ID NO: 501 - DNA, 1254 bp, Artificial Sequence; identical to SEQ ID NO: 499
  Synthetic

SEQ ID NO: 502 - DNA, 1254 bp, Artificial Sequence; identical to SEQ ID NO: 499
  Synthetic

SEQ ID NO: 503 - DNA, 3583 bp, Artificial Sequence
  Synthetic
ctggaagatactatgcgagccatacttcatggcttactcatcacgcacaaacggggccatgcttatatgtagtggtgcctaaccgctttatttatatacccccgagctccctcctttcacgacttgactagattctcgtcaaccatcaattctaccatcactgatgcaaatattttttggtttttaaccgcacacacaactaaccgccgatctaggactcgcttccaaactttaacaagaatactcaagtttgggaaagtagcctttttttcaaaaagcactacgatgtacggtcgtggtggcggcggttaccgaggagaccgcggaggtggtgggggctaccgaggagatcgaggcggtggtggaggctaccgtggagatcgaggcggtggtggatatcgtggagataggggaggaggtggtggtggtggataccgtggaggtggtggacgtggaagaggaggaggacctagtaacgatggaccacctatatttcaagacaacaatgcatctccaatcgacaccaccgtagctacaatagaagatcaatttgctgcaaatgttggctctgggcagccaatagcaaatttatcagcatctcctttggcagttatgccactccggcccggctatggtacacaaggaaaaaaggttgaagtatttgcaaattacatcaagatccaagcacccaaagaccttttgcttacacgctataatattgaggtaatacctaagcctgacgaaaattcttctggaaaagctgccgatagcaaagttcctacaggaaagaaactgaagcgcataattcaacttcttctgaagcttcctgagttttctggggttgcgtctgagtggaagtccatggtcgtatcttctaaaccacttaatattcgcgatggacaacaatttgagattaagtacgttgaagatggtcacgatgaagctttggatagagcaaaatctttcttggttcgagctgtgacaccactctcattctcagtctctgattatgttaattacttgtctgcgacaacacccaatgcaaagttttcacatggacttgaaacaattcaggtattgaatgctgttttcggacatcagcctcaatcccatgacggcaatgtttcagttggtcaaaaccgtcattttgctattgagcctaatggtaccggctatcatagctgggaccttgatgggggcttggtatctcttcgtgggtattttcaaagtgctagacccgcaactgggggtatattactcaacgttaatactgtacatggtgttttctttgaaccgattcgccttgatcagctttacaataaattaggcgctaataataaacggaatctcaatggcactttgaaaggtactcgaatcaggcaggttcatctgccaacaaaaaaaaacaaacagggcaaagaaataccaaacattaagtcaatctggggcctagcaactcctggtgacggaaagggcggaaaagatgaaaacccaccgcaagttaagtcatacggtgcagggccgaaagatgttaggttctacataagcgatcgagctggagattctggctctgcagcttcatcatctcttccagttaattcgtacatcaccatatatgattacttcaagataaagtatccccaagtgaatttaaacccgtcaaattctgttgtaaatgttggatcttctttgaggcctaattatcttccggctgaggtatgtattatggttcctggacaaccagtaaagaaaaagttgggaccaaatcaaacacaagaaatgataaagtttgcatgtcgaacacctgcccaaaatgctacctcagttgttcaagatggaagacatgttttgagcctgaactctagcaaccctgttctatctgaatttggccttcaagtaggtcagtctttgatatcagtaaatgctcgagtactacaaccaccgtctgtgagatatggaggatctggaagtctatcaccgagaaatggtagttggaatatgattaacgtgagatttcatacacccgccaaaatcggaccatggacttgtattatgtttcccacccaaggaagaaatgacattgatgttggtaatatgagatcacatgtcactgctttccaagcacagcttcaagcagctggagttgcggcaggagaacttttagccccaagtcctgcaacttgtgaagtttctcccgttgatagagaaggaaatgaccgacgcataagagaagtattcaaacatatccagaaccgtacgccacaaccaagattagttctgtgtattctgccaagaaatgatactggactttacagtagcataaagacagcagccgacacccttgctggtattcacactgtttgttgtgtaaattcaaaatttaccaaacaacaacgtcaagaacaatactttggtaatgttgccctaaaattcaacctgaaggctggcggtatcaaccatgttttggatcctgcaaaacttggtatcgtaagcgaaggaaagactatggtagttggcattgatgtcacacatccctcgcctgggtcaagagaaggcgctcctagtgtagctggaatcgtagctagtgttgataaatttctgggacagtggccatctgcgtttagtatccaagccaaatctaaaactgaaatggtgtctgatcttcagggactattcgccagtcgtcttcagctatggcaaaaacggaaccagggtcagttacctgaaaatattctgatatatcgagatggtgtttctgagggacagtacaaattggtactacaggaagaaataccacaaattcgtaatgcatgtcgacttcaatatcctgccacggataccaaacgcggattaccaaaactcacagtagttgtgtgtggcaaaagacatcatactcgtttctatccaaaatcgactggcgaagctgataggtcattcaattgtgttgctggaactgttgttgatcgtggtgtgacagaaactcgaaactgggatttctacttgcaggctcatgcatgtctccaggggacagcccgtgcttgtcattattatgtcattctcgatgagattttccgaagcggaaaagtcaaggcccctcacagaaaccatgcggatagcttagaagatttaacacacaatatgagtcatctctttggccgagctacaaaagctgtcagtttgtgtcctccggcttactacgctgatcttttgtgtacaagagttcgttgctatttatccgacatgtttgatcccagcgaagcgcaaagcgtattgagcggctccaccagtactccgacggttgaaaatgttgtgattcctaataacttgaaagatagtatgtattacatctagcgtactcttgtagactggacggggaggtttttttcacagatactatgtattaaaatcaagctatttaattaggtgatagcatagtgtttcagcgaaagaaaacagtttagaatagtcatgaatttatttttgcttagaggaactttttctatcactaattataaatgaattttctccggaaagtcccgttagggtagctgaaacttctccgtaatatcatgttgtgtgacag

SEQ ID NO: 504 - DNA, 3117 bp, Artificial Sequence
  Synthetic
atgtctgactggggcggttcgcgtggccgtggtggtcgtgggggtcctccaagaggtggaggacgaggcggaggatatggcggtgatggcggctatagaggtggtggtggtggctacagaggaggcggtggtgggtatggtagaggtgatggaggtggatatcgaggaggtggtgatggcggatatcgaggcggaggcggaggatatagaggcggtggtggaggtggaggtgggtttggtggttctatgagaaaagaacaaaaagtctttagtgatcctaatgctcctttagcaccagctgattcgcaattaaaacaattggaagacacattcatggccaacgctaaaaatatgggcaactcggccactgcgtcactagattcaaatcttccccttcgacctggatacggaacgcaaggaaaaccaatttccgtctattcaaattacttcaagattgatgttcctcaagatcttagacttgcccgttataatatttcagtctcacctgaggctaaaggaaagaagatggcccgtgttgtcagtcttcttctagagaggccagagttctcaaaagtacaaacccgattcgctacagatttcaagtcatttttggtcgcgtctcgtcccctaacagatatgcctgctcaatggaacattcgctacagtcctgaaggacatgatgaagccggagaagaagctaaggtttttattgtcaaactccaggagcctgcctttttctctgtatcgaactttgtaaaatatctttcaagtgcaaatgtcaaagataattttaatgaggaagaacaaaagtctattattcaatcattgaatgtagtttttggccactaccctcaatcccatccaggagttgtaactgttgctggcaataagcacttttccttggccagaggagaaaataatataaatataaggcctctaggagatggtcttgaggcctaccgtggatttgtacgaagcactcgggcagttacaggaggtattctattgaatatcaatgttacacacgcagtgtttttcgaaactactaacctcgccgccctatataagaagatgggaacgcaaaatcgtgtcaatttgaaagaaaagttaaaaggaatgcgaatccaaatcacacatctgcccccaaagattaataaaacaaccggaaaggttataccaaggattaaaaccattcaaggccttgcaaatattaatgatggtgccaaagaggagcatcgaccagaggttgctggatatggtgctggtcctcaaaaggtcaagttttgggtatctgaagatactggcacttctaaaaccagccaaaaaaaccccttgccatctaacacttacatcagtgtatatgattacttcaaaaaaagatacccaaagattgaattggatccaataaatcctgtagttaatgttggaaacagtgaacaccccagctatcttcctgcagaagtatgccaggttctacctggaaataaggttaatcgccgtctcagtcctcgacaaacgcaagaaatgatcaaaatggcctgccgaacaccatatgagaatgctgaatcaatcgtaagagatggcaagtctatattaggccttaaccctggcgacaagtcaactagttctcagtttggtttaaacattggtaaagggctccttgtcgtaaatgcaagaactcttcatcccccttcaatcaattacaaaggagctcgagtgaatgtatcgaacggtagttggaacatggcccgacaaaaattccataccaacgcccaactaggtacttggtcattcgttcttttcaaaccaccgccttcaaattcaggacctagattggaagaagacaaaataagaaggtccgttatgggtttcagagattttctcgaagggaatggaataaatgctaaagggttggttccgaatggagtagccgttgatcttattggtggagaaagggctactcaagtcaatactgaaactaccggcctgttattcaaaagaatgtgtgaaagcaacaataaacccaaattccttctctgtgttatggcggcagatgatcccagcttatataatattataaaaagtatcggtgatacccgagctggtattcatacagtatgtgttattgggagcaaattcacaaaggagaaaggccagggacaatattttgcaaatattgcacttaagtttaatatgaaagcgggtggtatcaaccatatactagaccctgctaaattgggggtaattagtgagggtgaaacgatggtagtaggattagatgtgacgcatccttctccgggctctaaacttggaacacctagctctgttgctatggttgcaagtgttgacaaatttctggcgcagtggcctgctgatttcagaattcagatgggacggcaagaaatggttagtgatgtggagggacttttactcggtcgcctcaagctgtggcgtcaattcaataagaggctcccaaaaaacattatcttgtaccgtgatggtgtttctgaaggtcagtatggtatggtccttgacgatgaagtacctggaatacgtaaagcttgtagacaagtctattctcctgatgagaccaagcaaggattacctcatctctctgttattgtatgtggaaaaaggcataacacacgttttttcccagcaactttggctgaatgtgatcgatcatctaactgccttcctggaactattattgatcgtggcatcacaatgaaccgaacatgggattttttcttacaaccacatgcctgtattcaaggaacagcacgtccatgccactactttgtggttctagatgaaattttccgaaaccgtgcattaaaggctcctcaccaaaacgttgcagatagccttgaggacctcacccacaatatgtgccatctatttcaacgagctacaaaagctgtcagcttatgtccacctgcgtattatgctgatcttttatgtacaagactaagatgctaccaggctgacaaatatgacccctctgatgaggagagtgcagttggtagtattcaaggaagtgctcccttagctactccggcacttgtagctccatcgatacacagtcaaataaaagactctatgtactacatttaa

SEQ ID NO: 505 - DNA, 2876 bp, Artificial Sequence
  Synthetic
atggctgagccacctacatctggtcgttctggggctactgtggaaaagtcttcaaaaacacaaaagccaaatgtaccttctcttggagccgaacaaagtatgagtagactcacaatatcggaacttccgcgagtgattacgaatacccgaatcgaacttccacctgatgcttatcgtctagaatcagattatacttgggcacaggagctcccaagtcgacttggcttcaataacacgggaaaagaaatcacaattcgagtcaatcaatttaaagtaatgcaatggccccaaaaggatgtatatcaatacgatgttaatattggtaatggtgctgagaaacggggtaaaatgaaagctgtatggcaatcaaaaacacttcagatgtttcttcgccaagcaagtgacggctctccaattctctgggatggaaataaaattgcctggtcttctcaacttttgccagaattgcgtgtaacagtcgatctagatagcgaaaaaggacgagcacctcgacctggaaagctccctgataattgctatgtggtgattcggaaagtaaaatctatccggatggctgtgattcagggttatttgcgaaagcaaataccctttgacaatacaatcttagaagctatatcctttcttgatcatgctatgcgacaggggccatcagaacaatataaacaaatcaagcgttcgttttatagccagggaaatgcctcgaaaaaactagatgatcttatttatgctatgaaaggtgtctacacatcaataaggctatgtaatccaacatcatctgtagggcagccaagtactggccttgctgtcaatgttgatgccgcaaatggcacattctggacctctcaggatctgcatcaggcagctcgtaatctatgtaaagaacgaaaccgtcagttgcagtggaatatttttcgcgatttaatacagccagttcgagatccgaaggatggtaggtggaaaaaatcagaggattggaagaacctacagaaaatggctagattacagtttaccgtcaaacatcgagggaaaaatgatgatcataaagtctattatataaaaggatttactttctctggtgagcaaggtggtgctcactctaaaaacacatactttagccttaaaaatagaaaaaccgaccctcctacggaagagaaaatatctgtatatgattattttaagaaaacttataatatcaatattcagttttgggactttccgctggtaataacaactcgtgacggtatgtttcctatggagttgtgtgtaattgcccctgggcagcgatataatttcaaactaagtcccgatcaaacttctgaaatgattaaattcgcggtaacccgacctaaagagcggatagattcaatccaacacggtatcaatatgctccgatgggataaagatcaatatcttaaacattttggtattaaaattgatccaaatttaacacaaacacaagcaagacttcttccagccccggatgtgtcgttttctggtggcgcaaaaataagtcctggaactgcgggtcgttgggaccttaggggtaaaaaattctatcttccaaattccgaacctctaaaatcatggggagtgtgcattcttggaaattgctgtccagagtctacggctcgtaactttattaataaacttgttcaagtctattccgatcacggtggcagaatcgaaaataggaatcccccaatttaccaacaaacccggaacgagcctttaccggaggctgttgctaatgcccgaaatgccgcaggaaataattctaaaatgatgcctcaaatcatgctttacataattaaaacaagagattcctttaattatgagcgtctcaaaaaaaataatgaaattcggttcgctattatttcgcagtgtatgaacgtggctcatgtagtgaaagcacaggcacaatattgtagcaatgttgccatgaagataaatgcaaagctgggtgggactacttcaaaagccatcattcctggcaaaaaggaaatatttcctcgtccaacccttgttatcggagcggacgtttctcatccgagtccgggtagtcctcaggcttcaatggcagctattactgtttccctagattctgatgcctgtagatttgctgctgcggcacagactaatggccggcgggttgagatgatagaaaaaaataccatcaagacacaaatgatgccacttgttggtcaatgggtcaaaaatgtcggtaagggaaaactcccaatgtatatatattacttccgtgatggcgtctcagaaggagaatatagccatgttttaagtaaagaaattaaatggactgtcactatctgtactaagcgtcatcatcttcgctttttccccaaggagagagatggcaatgcaggcgatcgtaacaacaattctctaccaggtacattggttgaacgagatattactcatccattcgaaaatgatttttacctatgttcgcatgctgcaatacaaggaacagctagacctgtacactaccatgtaattcttgatgaggcaaattgcccaccgaatgattttcataaaatgatctacagtatgtcttatcaatacatgcgctcaacaacgccagtgtcaataattcctgctgtgtactatgcacatcttgcttctgctcgtgcccgagcgcatgaggatgtctttgcatctgaaggacctcggggcggtcaaaagtttgaagagcgaagacaagaagctgcaatcagggccccttctaccgtgacagattcgactcagttctcagatgaagttaaacctttagcaccattaggtaacccaaataatctagaagcaatgattaaaattcgcacgagcatgtggtatattta

SEQ ID NO: 506 - DNA, 2217 bp, Artificial Sequence
  Synthetic
ttggcctggtatgctacgatttctactgtagctgcaggtagcgttattatttctgcatttcatcagaggtcaaatttctattcagcatgtgtataccttgcgcaaagcaacttgtgtttgatgatacttacaaatctaattttactcatttacggtacctttgtgtatagtcttcaaagagtttgctttgggcctttaaggcctatcgagattgagcagctttacgaaaagggatggtttgcagtcactgaaacatgtctagctatgacaattttccgagaggaagttggggcatggtttttaattatgttcgttgcacttttaacgggcaaagtttggggttggattggtgacggtcgtgttgagatcttaggccagcaacctcctgtaaatcctcgacttttccacatacggctatctacttcactgattatgtcagttatttatgatctattaatgatgaattatatcattaaaattgtcatacaacaagctcggccaaatatgatggttatgtttcttttcgaatttgccatattgacgacaagttctttgtcaacagcatgtcgatatgggatctcattaatggaagctaaagttattaaaatgcagactgttgaaagattagatgaacgacgaagagaagttcgagaagaaagagctcggattttcaggcaacgagaaacaaatgcaagtacaaattctgaaaatatagcttctgaatcaaacgcaccacttccctctgaggacgatgttaatgaaatggatattgaggttcctggttgggaaacaaagggtcagtgggtcttaactctcgatcttgtaacagattttataaaatttggaatatacacctcattcttcgttgtattattgatgttttatgggatcccaattcacatagtacgtgatttactactaacagcaagatcttgcatgaaacgattaaatgcattcctacgatatagaagagcaacctacgatatgaatgagagataccaagatgcgactgcagaagatatacaacgagaagatacatgcattatttgccgtgaaattatgagaccatgggctaccatgaatccacaaccgcctgcagcaccagcaccaaatgataatgtaccccctgctcgccctagcacatcagtaaatgaaagaaatcgccctaaaaaattgccctgtggccatatactgcatttagggtgcctcaaaagttggttggagcgacaacaagtatgcccaacctgtcgccggccagtagtagactctcatggtcaatccacgaggactgtgcctaatactggtgcaggacagggccaacctcaacctggtcagcctgatggagctggaggaccgcaaccagcacggggaggtatgcgaatgcttaactttggccctttaagggttggatttggtcaagcaaatctgcatgatcttgctggcgaattaggtggccctcaggcggcaccagataatgctcctgttggaggacctagagtttatggattagagcttggatttccacgtcgagcgcaggcaccacagcaaccctccgggagtacaaatatgcagccagtattaaatttgcatgaacaactaaaattatttgaaacccagatcctgagcgaactaactgctcttcaattgactcaacaggagtggcagatcataaaccttttacgagcagaactcgaaagggttcgagcaatacgaaatggaattgctgagcctatatcaggaaatataggatcttcaccggtatcacaatctgatcagtcacaatctcgagctggcccgaccttcattcctcgagtacaagcttttcaaccatcctccgcttctatcataccatcagggcatgctgatctcccccagggagtaactatacctgaagggtggtcattacttcctcttcaaagtattgatgaaacgattctcacacagagtactagaatatcacctatggtattaaatccaaccctaaactcaatgcctgtgcctgatactaattcaggcactgacctaagtggttcaaagaatcatactgaacctgattctggattgaaaaactcgcctttaaattcctcgacgggttcagctagtaaaaacttgaaaacaccagcgtctagttcgagtaaaacttcatcgtcagtcatagaagaaaatgcgaatatatgattattactctattgtaacccctagataactatgtaatct

SEQ ID NO: 507 - DNA, 358 bp, Artificial Sequence
  Synthetic
cgaaaattttccatgttacaatccatgcaccatccattaagcgaaaataaaccatcactgttgagaaagaagttaaacgtgatttgagctgttataagagttgagtttaacacagtattttgaatttgttctaatcctgtacttgctatttttgaatcttcgagtgatggtgcaagatcaacgttgaagtgtatgatagaatctggtgcagtttcggtacttaagtacagatatgttgcaatgccaaaactatcactagcaccacgcatagcaaagaaaatatcgggatttgtatcatcactggcgaaaatttcctgtccatcagcaagaataacatccataccaacgatgtgatcaa

SEQ ID NO: 508 - DNA, 988 bp, Artificial Sequence
  Synthetic
tcttttatgccatctgcggtgacaaaaatcgatggaaaggatgctacttcatttatatacgatctgatgattcaaaatagtcaacatgaccccgatgcacagtacaacatgatgatgtatggaaaggcttatgacactcggtttcccgattttggctacaaggggcttttctcgctcggtagtcggctttcttacttttatccagggccaagtacaactattcaatttgagaacggtacagtgagggaatttgagaactatgcatctgtgattggagactttgacggcgtaactgacggatcttcaatgtatcagaaattctgctcagggccttcaaaaaacaagtcaaaagttatccataaagtaaaacctacagctactcctacatcaaacaaggaaccctcgattctaccaacagacaatgaaccagttgaggggtacccgactcctcatattatatcatccgataagttggtatcaggataccttctcgatgatcctaatcatcttgacgtagcgattctcgtcattttctcattccaggctaaatctgtgctccaaacacagtcagtaatacagactttaattgctgagtgtttatctttggggaaaacaaaaatgattattgatctctcctcgaatagtggaggtaatttggtcgttggttatgacacattccgacaatttttccctaccattgaacagccaggttattcacgatttcgattacacgaggcgctaaaaattattacgaaacagatctcgaaaatcgcatcgaatttctcttttacaagtacaaaccccactgattatgattattaccaaactccgtttaattatagattcgatctaaatgaaaccaatgaaaaatttcttagctacgaggataaattcagtccaagaaaatttaatggtgatgaattcactagcaatatgaggtgggatttggaggatccaactatgaccagttctacctggggttctggga

SEQ ID NO: 509 - DNA, 1301 bp, Artificial Sequence
  Synthetic
acaaagctcgttggaaagtcatgcagatgtgacaacccttctggagaagcggcaaaacatcactgcgaaattgcttcagtcaccatatgatctcattctctatctggagagagcttcaatctatgttgctttgggctaccccgatctagccgttggtgatagctacagagcacttctgctttgtgacgaatgtacttctaatgggggatttgaatatcaggaattggcctggtctgcattagaaactcgctgtctcgatgataatttacctgaaattctgtcaaatcaagtaaaaaatgatcaattcaaccccgaagtagccgatattttatattcctcatttgaatcttctgacgaaaacctaagaaattttgaagagaacgaagagttggaaaatggttcttctatacccagccatcgaagctttattgttctaagagctgcctatcttgcgtcacttcaatgctatcgtaacttagccaccggcctactcctttgtctctgccaaaaaagtgcctatgaattttgctcaagaggcctaaccttagttcctgatgattcggagcttctcttggtcaaaaattatattgaatctacagctagaactaaagatgccaatggaattgaaaagctagaaattaagaacttgccagacgagggttgggcgagacgtgaggcttatccttggaatcaatacgagccagatcgctttagttcctctactcttgatttcctcaacactaaattggcaattattgcgccaaaatgtgaggtaaggattactaacttgctgagcttgaagaactcatcaacaccagtatctttagctggtaaacaagttaagcaaattcaaagcaacttaccatcgacaagtaaacaacttggaatatttgcaaaagaaaacatcttaccgggcgaatcaatccttaaagagctgtcatatctcactgttaataatagactcaaaggccctctatgtgatgcttgtagtgctgaaattccttctctatatgaaactgaaagtacagcaatgagctgtctcgagtgtgatgaaatctcattctgtagtgatgaatgcaaacgtggagctgagctcgaatatcatccagcagtatgtggtaaagatgttgagacaattggcaaggactggcccgttaaggaaaaaccatttggtctttactttcttcttctttgccgggctatagctatggcctcgacccaagaccttcatcctctaaatcttccccagataaaatatatttggggcggttttcttcctacttttgaaaaggctacatcga

SEQ ID NO: 510 - DNA, 309 bp, Artificial Sequence
  Synthetic
catcaacgtaaattttataagcaaggctctggtaaagtggaaccttactttttaatcctcaacaaggaaggagagttcattgatgtagtcgttgaagggctgatgaataacttcataagatgtcaacaaacaagaaaaatctctacagaattaatttcagatgcacctaatcaaccggtaccatctcaaatatctggatatcaatgtggtaaatttttttttagcaatgaggaacttgagaatactgcaaatgtggctagagatatcatgcttcagagaagtcaaaataaaattcccactaagtataac

SEQ ID NO: 511 - DNA, 709 bp, Artificial Sequence
  Synthetic
tgccttcgcggtgtcttcctttccagagcctttagtctttgaaggattttcttcttcatccccatcttcaccctccgcttctgcattgacttcgtcggccttttttgcttttttttcttccccagatttgcctttcgttgttagagctcctaggccactagcgagagaatttgaaccattaccaccgccaacaagaactcctgctttacctcctatggtcacctcttgaatactctgactttcattttccgcagcattggcttgctttttggaagatgagctagagtcatgtgatttttctgaattcgatgccttatttttctgatcttttgtttcttcggccgctgataccgctcctgcgggtcctttgtttccaatattttttccacttttttcatcttcatcatttttacttccaccagttgagctaaccacagaggttgctccttgatttccactcaagatagacagaatttctgataaattattcaaaccatttgtacttttagtttccgctgacgcagctccctcagcttgaactgatgttaaagcatctaagcctgttccacctacagttttaccgctagatattacttcggaaccggaaacatcccccacagaagagattttgactcgctttgctaatgaagaagggtagccaagagatttagcagttaaagaaagagcaataaatgccgtgttaaacttc

SEQ ID NO: 512 - DNA, 489 bp, Artificial Sequence
  Synthetic
cccgaatgaatgctatcaacatgggatagtagttcacgttcactccgaaattttatattacaaaacatacactctgcatgttcttttcgaatatgagcctgtaactttgaataacttgtgaagcctagatttaatggcgtaccatctgaattaaaagatcctgtcaagcaacattcattacagaaatatcgagcactgccatgagctcgctcttggtgtcgacgaaggctggcggaactatcgaaacctgagttgcaactttcgccagtgacagggtcaacatggacacagggatacggcataagctgaagatgttcagagcgaatatgacgctggagagtttgatgttttcggaaattttggctacagggtgggtaatttgtacatttgaattgtttacttccttcatggaccttatgatgtctttttagacgcgttgaggttaaaaaagctttaccacaaccttcccactcgcagtgaaaatttcgc

SEQ ID NO: 513 - DNA, 761 bp, Artificial Sequence
  Synthetic
cggcgttgtaaatatcgaagagttatggaggcgggaaatcgtgggcttgatcttgagagagagttaacatgcacgatctgtacagagattctatacgcgccacagacgcttctagactgcctacacacattttgtggatcttgcttgaaaaagtggtttagctggcaatatgattcttggaaaaatactccccaatctctcccagcgactgcatcaaaatttacctgcccagcatgtcgtgcgccagtgcgcgacacaaagcacaattctacagtgacaacgctactcgaaatgttcttgactgcaaatcctgataagtgtcgaagagccgaagaactggaggaattaaagaaaatatactgccgtggcgactgtgtattacctaaggttgttaccggagaaagggagttttcatcacgacaaagacgagtagaagactccgatagaagccttgtcgatgaaattcgtgagataagtttacgagaagcacttacagaaaccccaaatattcgaagagggcagaaccgacgagaccatgaggattctagaaggcctagctcctcaagaactaggcatacaaccccggaagctagaattgctgacgagcacaatcacactaggagacgaagaagagaagagcgaaactctaggcaaagtcaagaaaacacttcccaagtcagtgagaccttgcggaggcgaagccgaagtaatgaggagagacaaagtcgtcgagaaagccataatcatcaagttgtccacca

SEQ ID NO: 514 - DNA, 606 bp, Artificial Sequence
  Synthetic
atttattggctgttgtacttgcgctggcacttgggcagttatttgcacaggtagttgcacaggcagtgaaactatctttcgctgctgctgctgcattgctttgggaccttttggaatcttaggattttcaagcgattgttcggctggccgtttttttgggttgttagtactatcatttgtgacacttatctttgattcagtagatgagttagatggggaattcacattgactgctatcggttttagtacagatggcgatggtgacttggacttgtcttttttcatagtcattgtagtttgggaattcacaatgggactgttagatttctccctctcctctcgcacgaggttatttttttcttcaagatactgctgtatctcaagggacatagcttcatcatgtataagatcatccaacaatacaccttcagtctgacaacctggacaggtaaagtcgctctcgatgagcgagttagtaatgcagtcattgcagtacgttttctcacaacatggcgttttcattggatctatgaatattctcttgtcgattgaacactccaatcctctatcttgtatttctttattacccacagcagccactttttc

SEQ ID NO: 515 - DNA, 356 bp, Artificial Sequence
  Synthetic
acaatttgaaaaacacacaaccccagaagaatacgatagcatatcattggccaagcaccctcagttgcatgttgaggatgattcatggcatagagcaactggtacttgtaagtgtaataactgttaatgaagtatataatcccaaaaaatagaaccatataaccagccggtagaattgagtatacaatacacaaaatgtatacaaggattgcagagggtagataaaacccgtatttgaagacaggaggctgtgtaagctcccagcgatccctagggctttttgaatacatacgcataattggatatagagacacactgccaaactctaagagccttaatggtatgaaaccaacgcc

SEQ ID NO: 516 - DNA, 747 bp, Artificial Sequence
  Synthetic
ttcatatacgcttggcctatctcctcagccagctgtggatgacgtttatgaagaaataaatatatatctttgtatcgtataaactgttgctgttgaactatctgggcgttaacatttggcgagcgcaagacttttatttgagaaacaaggaaatctctaattctttcaatagctttacaaatgagagtttcaagaagaggttttaagctgattatgcctttaatatttcgtcgatctttgatttttgagtcaaatgatttggaccttttttcaacatcagccaatgcttttacccatgcctcgtccattgatccatcaacaattttcctaacagttgctattggaatgctgatttcttcaacaataggaccgagtatctgttcagtattctttcgattatctaaacttatgcttagagcatttgaccgggcctgtatcgtttctatatcaacagagacttgcgccaagtcatcccgaaaggttactaaattcgattcaactgagcttaatacttcatcgcaagcaagaatagaattgtgtagctcaactaggctagccttatctttttcgcactcttcaattatttctgaaatagtgaagtcttcttctgtcccagaaaacggtaagctagcaatttcctgtaagttcagtccctcaaaatctatgtcatcaactaattcatcatgaatcatttccccataatttttttcgggcggaatgcataatatttcatgttttgaaggattc

SEQ ID NO: 517 - DNA, 1295 bp, Artificial Sequence
  Synthetic
cacagatgtagctgaagatctagctggcttttttttacaatgtgatatctgtaaggtttggcaacatggaggatgtgtagggattgaaagcgagagctcaagtcctgatgagtacttttgcgaaaggtgcaggaaagatttacataagatttttaccgcgactaatgggcaacgatactcacactacctaccactttatcaaagtctttctcgtctaacaccccgtcctaggccatattcaaaggatgaaatccagtcacctaaaacagcagggactgcaaaatttcaaagcctacaggcaaatgcaaagagaagatctacaatgaatagcagggatgcagcctatgacgaagaagagcagatacgtcgagcaattgaggctagtaaagatataaaagctgttgaaaacgttgacggatgtttgaggcgcggtaagcgaggccgaagtaatagccaagaaaaaattcaaggcctaaagagacagcggactgattcagcttcatcatcatcgtcatcatctcaagaatttaatcaaatatcgcctcagcctgaatcagatgatgggggtaatgaacgtatgataaatagtaagaaaccgcgaagtacatgctcgaagaccctaagggaaaaagatttgaaagatgataaagaaaagtccagatctgatgctgtagctaaaagaaatggtcgtacagagcggagaagaactgaagatcaagaaacacagaaggaattgtcaattggtactaaaaatacaatgtgcaatagcacagactcttctaaagtctctacaacgattgaatctcttgagtctccgacattatcaaatggtagagtttcagacaattcatctaacaaccaatttccaatacctttaaaaaaaagctaccgtaattcaaattctaggaaagggaaattagccaaaaataatttcacaagggaatccgatcaacagatccatgacgatcaacattcacatcgctctcaatctcgagaagctcctaagattgatgatgtaccattgacctttagtaacaaaggatctcacggcgagccaagggttactaaatttaaggggaatcctagcaaagtttctatgacagatatgaaaagaagaatatcagcaatcctcgatttcatatcacgtactcaattagaaatggccagtgagtcaatttaccatataacggaaaaccccatccaaaaatcagctcaaatacagacagatgctgttaaaatattgcaagatgagtgtaatcaagagggttgccttgatgatatcagtcacggctcgg

SEQ ID NO: 518 - DNA, 773 bp, Artificial Sequence
  Synthetic
cgaagacggagtatgggaaggtttctcagaagataatgtttcaagtgatgatgaaaatctaaaagaagatagcagtgatgaagattcggatgaggatgatcctaagactcaagatcctttacttactaaccttaaaaatgacatggctaaaactagtagtggattatccagaagagcagcccaatttttcagtcaagacattttcaaagagattggcggaatctctgaagaagttgactttgagtcagatgttgaaactgaggaatcttcatcagaatcggtaaaaaaaaatacagagacgacagaaggagaactagttgaaagttccgaacctgatataaatgagcaaaatgcttcggcttttgagagtagtgaagaagataaagattttgaagtggttaaaaaacatgttgaggaaacagaatgggaagaagaaccttccaagaatggaagacttgatattgatataataaccgcggaagcaatgacacttgctcatcaaattgcaagtggtgagaagactaaatatgatctcatcgatgaaggttggaataaaaattcattcaaggatcgcgatggccttcctgattggtttctggatgatgagagtaaacatgataaacctcatagacctatcagtgctgccgctgcaaatgctataaaagaaaagctgcgagccctgaatgctcgaccaatcaaaaaagtacgtgaggctaagagtcggaaaaaattcaaagctgcccaacgacttgaaaaactccgaaaaaaatcgg

SEQ ID NO: 519 - DNA, 638 bp, Artificial Sequence
  Synthetic
cagcagtcattccattttcgtaaagatctgggtaaagaggcctccaacagactagactaacaactttagctggagcgtcttggcagtctttacaacgccaccgtattgaatattcatctaatcttaatctacgcaatatttcaatatcatcttgagtttttatttgatttttcagtggtggaaggtgctcgaaatgaaatgcacgtttgcaaccagtgcatctgaataaaacgtttttttcattgttgataagttcactggaaatctccgttataggatctattccttcattttgtttccggagtttttcttcttgtcgagcactcattttggtagagaatgcccaacatgaaaggcccaattcgcgacatactatgcacacatctagacgaggcgcagttttgtctttcgttatcgcaattccaatgcaacgacgacattgtaagacaaaattctcatgaccaattttagtaaccaagtgatctctgttacttcgaggaccaagacaatttttgtggattgaagttgagcatccttgacagtaaataagttggcttgggcccttgttcgaatttctctcatttccaaagcaaacatcacaaaatttattatgaaaacttcgaaataaattttgcttg

SEQ ID NO: 520 - DNA, 1773 bp, Artificial Sequence
  Synthetic
atgagcaattgatatcgtcgtattatggcctcttagaagaactgctaaagctgaattaacgagagtttctgattcagcatcgagagcagatgttgcttcatcaagaattagaatatctggatttttgagaagagctcttgcaatagcaatacgctgtttttgaccacccgagagttgagctcctcgcgcaccgacctgagtttcaagttgatcaggaaaatcacttataaaattacaattggcctttttagctgcagcaactatttcagcgtgagatgcatgaggaataccataggcaatattgtcagctatggagccggacataagaacgggttcttgtccgacgagaccaatccgtcgtcgtaaggactttgcattcatagatgagatgtctcttccattaatagatattactccagatgttggaagataaaatcttagcaataaggatccaatagtcgacttcccaccgccactaggtccgactattgcaatattgctgccagatggaatctcaaaattaagatcatcaaagatttttacggcaggccgtgtaggataagcaaatctcacatttgaaaatttgataataccctttgcagactcaacttttgttccaagtgtggagcaaattgatggttttcgatcttgaagttcgaataaacgactagctgcaccgactcccttcattaattctgaatagaaactcgagagccccataaggcttgatcctgcgtaggcagtatacattaagaatgatgttagatcaccaattgtaataataccgtttttgaccatagacccaccagaataaagaagagctaatatagtcatatttccgaagaatccagaagtggtgaaaaatgttgcactaattactgcttcttttctccctagcgcaaatattttttttatttgatgattatagcgcccaacttcttgaacctctgctgtaaatgcttggctagttcgtacatttcccagccgttcttcggcaatttttgtcaaggtgcccaaatttcgctgaatttttcgtgtaaggttacgtatcatccggccgtatatgaaagcactaatagccacaggagggaaaattacgcaaagaatacttgcaagatcaaggctaacccataccatagcggctaagccagcggcaccactaacgagtgatcgaagcccatctgaaagattttgagttatgcttttaccaactattacagtatctgagctcagtcgcgagagtaaatccccgactcgattggcgtcaaagaactcggcatcttgtacaaatgtccttcgaaataattttgatcggagtcttgaaattactctttctccaactattctcagaattaatatccgtccataattagctacagcacctattgatagtataagcccaagagccccgaaaaattgttgattattaagttcaaaaagtgtgtttccttctgagtttttggttgcaaggtctaatattttaccgattgaaaaaggaattgccattgatatggatgaagatactaataaaaagaaaaatgccaaactgagccacttggcctcaggcctggcgatctttactagtctccaaatttcgccaaatcccgagctataacgcagtgacttttggcttgagagtcgtgcgctgaaattgacctgagtcgcttgagttgcttttttacttctttgaaagccattttggagctcaaataatacttcttcgtcttctccaggacctgatttctcttgttgattttcaaaatggtggctatc

SEQ ID NO: 521 - DNA, 989 bp, Artificial Sequence
  Synthetic
ttcaaggcgactttcaagttcttgtttacgcttactggccaaggcatcatcggagctacggtagatggataattctgcttggcgaataagaccttgtgtctctattagagcagaacggaagtccgacaattcatcaggagcaataatttcgcctgctgaagaatttaggtgtaaaagttctactttttctatcaacttttgaattgatttttcattatcgctaaaaacttcaccaccaagatcaaaactagccatcatctcagccattttttcagctttctttttttctttctcgtcaagcaaagcggtggtctccttggctgacattttgacttcaagaaattgttgcttaacttcgtcaagctctgcagttaactctgcgtttgcatcctttagactatcgatagtaatctgggcttccttgctttcaaaagaaagtctttcagtctgcatcttatagtcatttacttctcctatcaatttttcattctccctaatagatttgatatcccgttctttgagataacttaattcctcttttatgtcttttagctttttttctgcagtcgcaattagagtctctttttcagcaatttgatcttgaagctcattttctctttttaaaaactcttcacgatcatctttttctaatgcaattggcgtagatgagcgatctaataacgttgaagcttccgatctagattctacctgcagcctagaaggagttgcaggtcttggtgtttttattttagaaagattagcagtatctaaaggtggtacccatttttctttaggcacactatctccagacctccactgctgaacttctgcatcaagtgtctgtacatattgttcaaatgtagtaacttgcgactgagctttccgcaataaagctttgagttccgcagggcttatttctgcatttatctttgccttgtttttgatagctttcgctcgcatgccaaatcttaaagtacctaaagtttctt

SEQ ID NO: 522 - DNA, 811 bp, Artificial Sequence
  Synthetic
tatcaattttatcaattggatctttggaaactgaagactcggactctgggttttttcctatcgaatttgtatcgtttaccaactttgggttactgagaggaaataaactagcgggattcattatcaattgcgaattaagtagtctctgtgggataggtgagtttggtcgagaatgcgtaggtaatgaaaaattaatagactttctagaaatggaaaggcttggacttggaattgggtattgataatttgaaatgttaggtccgccagaagattccacacgcgcattagaatctatggttaatttttgtgctgaagttttccgggtccgcagtgcttcattttttttcaatacacttttacttttcggcatgtcttgaacaataaggtcgggcaaagatgggataggaggcatgttcacttgagaccatgtggaggataaatcacggaatgagcgctgatacatggacccggaacttgatctccgtagggtttgcgactctttaagtgatgtatgacgatccccagatgtggatgctgaggactttcttcgaagtattcgttttgttttaacatctgcaacatgaacgggagttggaggtcgcgaacgcatggcagcagcagcagccgctgccgctgcttttgaagatgcggggacattagaagatgaatttttcaagagtgatttcgtagctttcgtagagctagacgcatttgaatctgatctatgaaggatagatctcgtaacggatctcttcctatctctagacatatcgacatatggaaaattaatacagaacagcttgcatcgact

SEQ ID NO: 523 - DNA, 443 bp, Artificial Sequence
  Synthetic
taacagttgacaatggatcttcgctatcttcttcagtggtatgtgcaagagattgacgtctagatgaacgtgttgatggtgcagttactacagcagtagcttcaaccgattttcgactcacttttcgcttgtttgaaacagacgaaactaaagaatttgtggaactagatttaggtttacgagtagtggaccgtcccttacttgtatagactctctttttaagtgtagaatcattcaatggctgtaaaaatgaaactaaatctccacaaatagtagtaggtgcatctgctgataatgcttcaggtaaatctaatctagatccaatttctgatgtactaagtgatatatttgaagaggtaatattactttgtatttcaggtgtctttgaggtcatctttgatgaaattaccattagtttttctgattcagatcctctattaaaa

SEQ ID NO: 524 - DNA, 589 bp, Artificial Sequence
  Synthetic
ttagttttatttgacgtctactgcgatgtggaaacatctttgcaatcatttcgaagtcagtcccgaacatacggagtcctttccagaataattcattcgatggtatgtcccaatgctgggaacgttctcgttttaagtaatcaccgcaggaaacaacacgagtaaaatcattttcttcaacaacatcttctgcagcaaaaaaattttctcgtgcactcttatggcggtcaatttgtagagattgctcatcgaagacaatctgaccatcaacgatgcgaattttaggaccaaccggaggagcagacggcggtgcgatttggctatttaaacttggctcagtctttctactttcatttagggtataattgtcaccactttttccatctatataatcttcaagttcagggttatctcgcttcatcctagctttgatagcattttgtttcattcgtgcaagtcgtcccattatctcatcgtggtttctagactttttaccaatacgaagatcatgacataagtcttgcatggtaataacagaaggatctatctttttggactctgctccttcaggcgtattttcacgtctttt

SEQ ID NO: 525 - DNA, 392 bp, Artificial Sequence
  Synthetic
tcgaggttctgataagacttgatctaaagtagggaagagagtttcatggcgaaaatgccatcgatagggtgtatgaagcggtataattggatttagtttattatcacatccaatggcaatactggtttcgtgcgcccaggctctagctacatttcttggtgtatagcctccacctccgagtaataatagaggcaggtttaaagatttgcaaaatgcaacgcaagctccatggccttgaacttggacgttgaagcgcccaagtcgatcaccagcaagggagtcagcaccacattgtagaacgagggcggtaggtcgaaacttctcgacacattttcctacaacggccttaaagaggtaaatatattgctcatcatcaataccatctgcaagag

SEQ ID NO: 526 - DNA, 1084 bp, Artificial Sequence
  Synthetic
agacactatctctttctctctccaccaaggatatgcatacctcatctgcttgcgacttgtgtgcttgtcagatttttcttttttttttctgatccactaccttgcaataagtgattataatgcgcactaacacttatcaaagtatcgattgagttctttggccgtttctcaagactaaagttatcgcgaaacttaacaagcacctctcccatctcaacgactttgtagaataaatcatagtgagatacaggactgtgtagaaatgcctcaccacaacataaagataaggcaattaaattaactagattgtcaatcaaaatatcaatattttttaagcccctcaagtctgatgtgtatgtggtgagaaaccgaacaagagaaagcagtgatctatatagttcagaccagtgatatttcaatcgtgtccgtgaccgagataggtatgataatatactataaatgataccaatgcaaagaatatataaatcaacatccagtcgtcgtcttagattgtgattgattccatcaagcatcgcatcaagaagaatagcagcaatcgatctatctccatgaacataaggaaggtacggagatttttgtcgacatagtcttgtagttattttattttcatcactgcaaagttgtttgcaaatggtttgatcttccaccaagatacgtataatgagtaaacaaaggtgagaatagtttgtagtccgtgatgaagtatgagcatgttgaagaagatatgaaataagcgaaagaagactgctgataggagactctaagtctttttcagcaggaagggagataagattaaggcaaaataatttattggcatttgtgaaatcatacgtagctagcaaaactgccgcttcagacccaggcagttttgcaaacatttcttttgcaacttctgcgtcaaaaactgggggtgcagaactcacggcacgcggagctatcgcgctcaggcccatcatgctcaaagtattactgattgaccatccctcgggagaatcattttggattgcaacatattctcctcgcagtttcgaacaggtataaccaactgatcttatgattttct

SEQ ID NO: 527 - DNA, 1311 bp, Artificial Sequence
  Synthetic
agtcgttatcggcaaaagtaatgcttcaaaagctgatacaaagactatatggagaggagctttaaatatattggaagacttaaaaaacgcagaaaaggattggagatttgggaaaactgaaattgtagggtttgacattgagagagagaaccaaatagattgccctcaaagtgatatggaaatcttgcagcaacagtcaagcaacactgcaagctatgccaataatttcacctccgaccttacacctgaaggccgcccaacaggaaaagttacgaaagctcgatttcagtctgcagaaataggaaaatgtactcaagttggatggggagtcgtacacctataccgtgatgataacgatgctgttaattttgatacccgaactactacatacgatggaaagggtgaaagtactatcctctgtattcctgctgtccccagttacctgacaccgagttattttctggcctggataggcgaaaagacaagggaacaggtcagtcatattagaatggttacgaccgaacgacttgcgcggtatttggtattaatgaagtttcgagatgtaaatacagcgaaaacttggaaggaaaactggaacggaagagcatttaataatacggagccagaaacatgtaatgttgtcttcattaagacagtatctttttcaactccaccctctacagaaatttcatcatccaccagttttccggccttgacccatgatccttttacaccacctggagcctcccttattgaactacctacctgtcctgtttgcttagaacgtatggatgatactactggacttctcacaattctctgtcagcatgtttttcactgcgcttgcttacttaaatggaaagattcttcttgccctgtttgtcggcacaccaacatcctccacttagactcacctctagaaagaccttttggatcaagtcaagcatctctatgcagtacctgtgactgtgctgatgatctatggatatgccttatctgcgggaacgtcggttgtggccgttataaaggaggtcatgcaaaagatcactggaaacaaagtgctcattgttttgctctagaaattgagactcagtacgtatgggattatgcggaagacgtctgggttcaccgacttattcgaggcaaaggcgaggatagcaaattgatagaaccaccaaaccaacaacaatttgatttgggcattaacggagatactcctcagagttatagcagtcatgatgagttagtttctcgtagtaaacttgaaatactaggcattgaatatacacaccttctcacgtcgcaactcga

SEQ ID NO: 528 - DNA, 471 bp, Artificial Sequence
  Synthetic
attctctgtcactatggatcggccttctaccactggactggtatcacaatctctcacaaggcccaagattgaaaatggaacgcctagaacagcacctttaattacaacacgaaggactccgaaaatgctacgatctactgtgtcaaattcctcgctttcctcacaaccatcaatgtcaccgcatcaatttattgctcttgcccgggaagcaatgaaaaatgctttggaagagaacaaatcaaaggcagctgaggccaaaagtgttagtaatgaacttaagccaggggttacgatcgattttagcaacaaacaaatccaacgatttcctgatgaagtaattgatataataaagaatgagcttgaaagacttgcgctgtcacataatcaaatatctgtgtttccctcaaggttttccgaatgcaaatcactccgatacctcaatgttagagataatgttatccgtgaattccc

SEQ ID NO: 529-543 - skipped (15 entries)

SEQ ID NO: 544 - DNA, 2016 bp, Artificial Sequence
  Synthetic
gccgcatctcttttacttgtcgaccccaagactacttcagcaaagcatatattcaaaaattctattaatgcatgggtccaagaatttgattatttgaattcttgaactagataatactcaattaattcttgctctttgtacttatacttaaggtagtattgaggcgggtaaatcggccattatgtacattgctgacattttgtcggatctactgactcaacagacgacacgatatgggtggattttcatggtcacaagtatcgcattttctataatactattggccgttgtgttaaatgtattgagccagttgctgttccgtagaccctacgagccaccagttgtatttcattggtttccaataattggaagtacaatttcgtatggaattgatccatataaattttattttgattgtagagccaaatatggagacatttttacatttattctcctcgggaaaaaagtaacagtctatctgggacttcaaggtaataattttatacttaatgggaagttaaaagatgtcaacgccgaagagatttacactaatttaacaactccggtctttggaagagatgttgtatatgattgtccaaattccaaactcatggaacaaaaaaagtttatgaaaacggctcttaccactgaagcgttccattcctatgtaacaataatacaaaatgaagtagaggcatatataaacaattgcgttagctttcagggtgagagtggcacagtaaacatctcaaaagttatggcggaaatcactatatatactgcttcacatgccttacaaggagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctaggacttatatgaatataatccaagctcgtagagaagagaaaagaagcggtgagaataagcatgatataatatgggagttgatgcgttccacttataaagacgggactccggtacctgatcgagagatagcgcatatgatgatagcccttctgatggctggacaacactcttcgtcatccacgagctcatggattatgctttggttagccgcacgaccagatatcatggaagagttgtatgaggaacaacttcggatttttggatcagaaaagcccttcccgcctttacaatatgaagatctttcaaaacttcaacttcatcaaaatgttttgaaagaagttctgcgacttcacgctcccatacactcaatcatgcggaaggtcaagaatccaatgatcgtgccaggcactaaatacgttattccgacgtcgcatgtactcatctcatcgcccggatgtactagtcaggatgccactttttttccagaccctctcaaatgggatcctcatcgatgggacattggatcaggtaaagtcctaggaaatgatgcggttgatgagaagtatgattatgggtatggtttaactagcacaggagcgtcaagtccatatctaccttttggtgcgggtcggcatcgatgtattggcgagcaatttgccacattgcagctagtgacaataatggcaactatggtgcgtttttttaggttccgtaatatagatgggaagcagggggttgtaaagacagactattcaagtctattttcgatgcctctcgcaccagccctgataggctgggaaaagagatgactgttatcgtaattatttatggcaggtgttagggttagaagaattgtctaaagaagatctacttaataagcaattgtgtttgacaaacatagcgtacttaaggggcttgaaccacaaatcgaaatgcgctaaatgtagttactacccggttagcagtctttatttcaaagtagagacgggataaataagcaagcttaaattctagtgtacgcgcttaggaaccgagatacgaagacccccatccccttcagggagttcag

SEQ ID NO: 545 - DNA, 2016 bp, Artificial Sequence; identical to SEQ ID NO: 544
  Synthetic

SEQ ID NO: 546 - skipped

SEQ ID NO: 547 - DNA, 536 bp, Artificial Sequence
  Synthetic
tgccattcgcgtatttttctattcgaagacactcagtccttcagagattattccagaattgtatcctcaattacaatcttatttttacacaatacctctttcccctaaataaagtactacaatgtcaaattccgaattagcagtttcgtatgctgcccttatcctcgcagatgacggggttgacgtcacagcagataagctacaatcattaatcaaggctgctggtattgatgatgttgagccaatttggactactttatttgccaaggctctcgatggcaaagatgtgaaagatatgctcctgaatgtaggctccggaggtggtggtgcagcagcccctgccagttcaggtgatgctggagcagcttctgctacagaagacaagaaagcagaggaaaaggaagaagaaaaagaagaagagtctgatgaagatatgggctttggtctcttcgattaaattaattcgtgtatataaaaaatatattcatatcaaaagtaacgtatttaatacttcatacgttggggcaagctttaag

SEQ ID NO: 548 - DNA, 594 bp, Artificial Sequence
  Synthetic
actcatcaatataatctactccgattgcttctagtatttggcattcaacaaaatggccaattcttgccttcgccataactggtatagttacgctagacattatctccttaatcatttttggatcactcatacgggacacacccccttcgactctgatatcagctggcacacgttctaaagccatgaccgcacaagcgcccgcttcctcagctattcttgcctgttttgcgttgaccacatccataattacgccacccttcaacatgcgagccaggccggttttgaccccaaaattcttttgtcccacaggctttgaggtgcctttattgattccattattaacgccaccatcagcagagacaggaatagggatttcagtggccatcttgcaattatctcataaatagtggtattagttaagcgcccgaaggttcttgtcaaattcttcttgcaaatattagtatcaagagtttgctgaagatataaaactaagaaacgaattgtaattaacaaatggattgtaaaatttctcaaaatgaccgcctggtcgatatgactatgacgtttagagccaggaagtgttgcaggaaaaac

SEQ ID NO: 549 - skipped

SEQ ID NO: 550 - DNA, 1386 bp, Artificial Sequence
  Synthetic
cgggcaacagcgaaaggttgtgaaaggaaacgttgtaatttacgtgcacgttcaacagttaatttatcagcttctgaaagctcgtccattcccaaaatagcaataatatcttgcagcgatttatactcctgcaacatttgttgcactttagaggctgtgtcgtaatgatcttggccaataattcgagggtcaagcattcgagatttagactcaaggggatctaccgctggatagatacctaattctgaaataccacgtgataatacagtagttgcatctaaatgagcaaacgttgttgcgggtgctggatccgtcagatcatcagctggcacgtaaacagcttgcactgaagtgattgagcctttggtagttgttgtaattcgctcttgcataagacccatatctactgcaagtgtaggttgataaccaactgcagagggaatacgtccgagaagagcagagacttcggagccggcctgagtgaaacgaaaaatattatcaatgaaaagtaatacatcttgtccttcttcatcacggaaatactcagcaatagttagtccagtgagtgccacacgagcacgagctcctggaggttcattcatttgaccgaataccaaagccaccttagattctccatcaagctgtatgactcgcgtctcttgcatttcatgatatagatcattaccctcacgagtacgctctccaacaccagtgaagactgagtaacctccatgtgccttggcaatattattgattaattcctgaataaagactgtttttccgacgccagcgcctccaaacaacccgattttaccaccacgggcgtaaggagcaagaagatctactactttaatacctgtaactaagacttctgcagcagttgattgatcagtgaagagcggagcatcagtatgaattggtgacttcttcgtgtatttaatgggtccacgctcatcaattggatcgccagttacattcataatacgaccgagagttcctgaacctactggtacagatataggtgatccagtatcagtaacacggtggccacgaaccagtccctcagttccatccattgcaattgtccttacaacattttcccctaaatgttgtgcaacctcgagaatgagcttttggtcaccatttttagtttctagtgcgtttaaaattggtggaagcttttcggtatcgaactttacatcgacaacagcaccaataacttggtgaatcttgccatgaattgtactgtcactcgcgaaccgagctccagcaatccttgagcatggatttgatcttaagatgtgccttgaggaattaatgacagttctttgaagagcgctccggaacatcttgagcgatgagcgcggttaattgatgaagttgaaa

SEQ ID NO: 551 - DNA, 844 bp, Artificial Sequence
  Synthetic
aaacactctgagaacctccggtccaactcaagtcagcaagcttcagccagaacaaaaggatggtaagttaaggcatcttccatttaaatccaaactcttaaaatcttttaatatttgatacaagtgcgcagaaatgcaaagtgaaacttgagaatttttgcaggatgttcggacttgattctgaaatgtgaactgcggattcgaaaattatgagctaacaaacaacagccgttcactaagttagttaaaaattcagcatacttcagtcgataccaaactaaatacaagcggcgtcggattggaaagactgactactatgctcgtaagcgcctcataacacaggcaaagaacaaatacaacactccaaagtaccggcttgttatccgatttaccaatcgtgatatcgttgcacaaatcgtcacatccgaaataaccggcgataaagtattttgtgcagcctattcccatgaactcaaggcttatggcattgagcacggtctcacaaactgggccgccgcttattgtactggtctattaattgctcgtcgagtcctcaagaaactaggtctcgacaaggagtttactggtgttgaagaagccgatggtgaatataatttaacagaggtatcagaagaaaatggccgtagaccgttcaaagcaattcttgatgttggactggctcgaacttcaactggtgcgcgcgtttttggagccttgaaaggagcatccgatggcggcatctttgtcccacattctgaaaatcgatttcctggctacgatattgaatctaaagaacttgacgccgaagtcctccgaaaatatatattcggtggccatatttctg

SEQ ID NO: 552 - skipped

SEQ ID NO: 553 - DNA, 276 bp, Artificial Sequence
  Synthetic
ttcggcatatcaacgtaaaaaaaaaataaatcgacacaaaacagctcaataccgtagtttatcaccatgcttacaattacgtaaacggaggtctgcaaagagccttaagtctttggaaatatcatgcagtagtggtattgaaaaaggaaccactagcttcgtaaactataccccagaagattcccagaagattttaaatggagttgctccgtctgggagtaacaagaccaaagctcgaagggagaaagaggccttggaaaaacgccaaaagttatc

SEQ ID NO: 554 - skipped

SEQ ID NO: 555 - DNA, 491 bp, Artificial Sequence
  Synthetic
ctcggattcaggagtgtataacgacaacagtaatgtctcatcattcaagccaagtctcctccgatttaatttgggaagttattcgtccccagaattccttcctagtcaaacgtgcatctagtggaggtgtacaattttctcgtgatcccctaaacttaacaaatgtgcattctcgcaaatatgccggatttgttaacgataaggctgtcggaattcttcccattgaaggtggtaaaggaggtattactttgatcaccaaaaaaactaaatttacccaaaaaccttctagcgccatatacacaacagtttttggtggtaataaaacttcaagacggacatataagggggttgtcaatactgttgtcaaatcaagatatcgatctgatcttcgtgctgaagctgttgctcgtgcgtctgctattcggtactcgcaaaaaccaaagggtgatcttcctaagaagaaattgcgtggatcaaaagctaaaaaggct

SEQ ID NO: 556-557 - skipped (2 entries)

SEQ ID NO: 558 - DNA, 425 bp, Artificial Sequence
  Synthetic
ttgagaaattattttctcttatagcgaatttgattgagtattttatgtgatattcacgttgttggacccttatagatctgggatttagggtcttagaagactcgtcttaaagcttgccccaacgtatgaagtattaaatacgttacttttgatatgaatatattttttatatacacgaattaatttaatcgaagagaccaaagcccatatcttcatcagactcttcttctttttcttcttccttttcctctgctttcttgtcttctgtagcagaagctgctccagcatcacctgaactggcaggggctgctgcaccaccacctccggagcctacattcaggagcatatctttcacatctttgccatcgagagccttggcaaataaagtagtccaaattggctcaacatcatcaataccagcagcc

SEQ ID NO: 559 - skipped

SEQ ID NO: 560 - DNA, 389 bp, Artificial Sequence
  Synthetic
ttggtctctaaataatgaatactcttcctctccaacctttatcggtgatccgccatactgggggattagaaccttgtcgccaaccttgacattacaagacactctgtttccatctttgccaactgcaccaggtcctacagctataacgtgggcttcattgagttccttgacacttttttcgggaagaaaaatgccactcgcagtctttgcttctgccttcactcgttgtacaagaacccggtcaagtaaaggagcaagggacttgattgatttgagtgttgaagccatgttagaggataacggacagtgaattataaagactgtgcaataaaattggtttaagagaaaagatctttgaagtcgcgttacgttaaagtcgctatctgttc

SEQ ID NO: 561 - DNA, 1350 bp, Artificial Sequence
  Synthetic
agcaggtttacgtatgagaccgagttcttgcgcccaggagtagtcgagaggtattttgggcacagcaggttcaggttgaggcttaatagtaccgtccttcactaatttgtcatatactgaggctaaagtacttggaagatcctcaaatgtcttggggacaaagaaacctgcatctcgcatagaagtgtttttaacagcagcagtttctaattgtgagtttgcgaatgaacctgcatgtccaaactgtacctcagttttaaacatgctagcgcatgttcctatggcccaggcaacaataggcttcgtaataattcctttttttactgcctctatgactctatattcctctactccaccaacttccccaagaagcaagagtatcttgcattctgggtcagcctggtatcgcaataaatgatcaataaaagttgtacctgggtatcgatctcctccgatagctacaccttcatatactccatctgtcgtgtttgcaatgatattgtttagctcatttgacattccacctgatttagaaacgtaacctactgagcctttgcggtaaagcttagatgcaactatattatccatcataccacctgtgttgccgattttaaaagagccaggttttattccaccaacagttgcaggtccaattatggtgatctttttttttttagcgatgtgaagaatttctcttgcacgtctctcaggtacaccttctgcaattatggcaattgatttgatttgaggatactccataagttccaacgtggaggagtaaacacttctggaagaagcaaagttcacaatagtatcaacatcaggatgcttggccatagctttttcaacgtcttgatatacaggcaaaagagtttcgctggttccccagtacattttactaacaaactgtccaccaaaagtatatataattcctgcaactgagggagtagatcgcttgcaaataaaatcaaaatctagcattccttgaacagctctaggctgaagaccatagacgaaacatcttgttttatcatggaagagtgtatgagttgcgtgagggctcaatgggcggctaggagcagcaaaccgacagatgttatcattggctgattgcccaactttcgtagtatcatttggagtagctgatggcattttaaaatattacaaggtcacagagtgtaattttgggcctgatttcttctgtagagatgactcaagtagtaatatttatctctttcaatggtgtagtatattaatagtatactcgggagagaaaatgatgtgataaaaattaccaatatcgagttccttttacccctgagttcacagtgttgatcttgtgactgaaaa

SEQ ID NO: 562 - DNA, 1733 bp, Artificial Sequence
  Synthetic
gcggctttgacttcattacattattaagagaaacactatgttttcttgttaatattgagcaatgttcctatcttgtagataaccttcctatgtgagatatcacaagttaaatttattaagcttcacaaacagagatagttataaggattgatttaaacctataaatcttataaatatatagattaaaagacatcattcattcaatgcggagatataattcactatgaataattcgttcatcataaatgcgttaaagagcgacagagttgtgtagtctacttaaacacctttccgtctgcccaaggatactctttaccgttaatggtaatgggtttttcccatgtccattgatcatcaataaattgcttatcttctatttttgtatgatctagtttagtgaattcatagctctcaaaatcaggagcaacttcaaaagctggttgaacatcttgtccacgtattaaaaaggcaccttgaataaccgagtcatcttttactccataaactgaagcggcaccaaatatatacttgcgagaagcttcgagtcgcgcgaagaaaccaccaattaaatttgatgacataaaaacctgagttagctcattattgtacttataatcaagcttccaaagtgagtattcctcagatttgtagttttcccagaaccatttaagagcatcagatgtgtcattattggaatattggcgtttccactcatctaaagcaagagttggtttaggcaaggactctaatggatgtttggctttgggtgcagcaggtgcttcatcttcatcttcatcctcttccttggccttctttttcgagggggccggggttttcggagcagactccttcttgacgtctttttttgctggcggctggtacttaacaggttcttcgatgaattcatgtttttcgcaaacgtcggaatatattggctgattgatcacagtctcataccagcgagttgtgtttggattggcagctcgccatttcttatcaaagagatacctaaatgataaacttaaaatacttgcagtgaatatatctgctagagtaagacgctctccaactaagaatgtgttgttttgaagagtatcctcaaaaatttgagcataatcgattgtttttttgacaccttcatcataaacctttttattgtatgcgacaataccaaaaaaaggataaagccagctggcatagcagttactaatatcttgattgacaaaagacatccactttaaaatagaggcataagtctaattatgaaagtccacacggagtgttaagacagggactgttttatgtcaaggaaaatttttcaactgagagagcttagcatactcctgcttggttttcccgagaagagttgttttttcattttgagatgtaatatatattgatatagctatagtctcatgaagaatgaagccatcagagccaacaaatgttggtattttgcccaacttgtttattttacgatattcttcgtctgtagatccaggtgtagtctcgatgagttctagttcaatattgtttgctttagcaacagcgattataggaatgccgcggggattcccctattttttaagagtcaattagtctcaagataggataagatatttggtttataagtgggaaaaattttctatgagtattgtcagtgtactgctgcatttttaccttcgaaacgtagagctttccaaagaccattttgagaaagttttgacttgcac

SEQ ID NO: 563 - DNA, 1854 bp, Artificial Sequence
  Synthetic
atcaagctaatttgggttctaattggatgtttctttgcaagatttggaagttcatggagagtgataaatttaaaagcttagtgcattacatcaccggtcaggggctcttttgacatggtccaatattaacaactctagtattttactatctattccgctttttaatggcttggaaccaatgaacatgaaaaatcagcttgcatgactattcgaaatggcgcaaagctctgaccatcatggacccttaaatcttccatctcccccgatcagccgacatctgaagtcccgttgcatggtaaatggtataatagattctcagtgattttaataagcaatgcagttcttattttttggcagcctttacagctgctttagtgacctttcctgccttttcttgtttctcaacactcttaataacaccaacagcaacagtctgtctcatatcacgaacagcgaagcgacctaatggaggataacttgaaaatgactcaacacacataggtttagatggaatcattttaacaattgctgcgtcaccagatttaacaaattttggagttgcctcaatagactttccagtacgacgatcaattttttcaagaagttctgcaaatttgcaagcaatgtgagccgtatgacaatcaagtacaggtgcgtaaccagctccaatttgacctgggtggtttaacacgataacttgtgcggtaaaatgctcggcacccttaggggggtcattcttagaatcaccacaaacattaccacgacggatttctttcaccgaaacgttctttacattgaagccaacgttgtctccaggcacaccctcagtaagttgctcgtggtgcatttcgacagacttgacttcagttgttactccagcaggagcgaatgtcacaatcataccagccttaatgataccagtctcaatacgaccaacaggaaccgtaccaataccaccaatcttgtaaacatcctggaggggaagtcgaagaggtttgtcagttggtcgggatggtgggtcgatagagtcaatggcttcgagaagtgtctttccagtactactgccagcttttgtttcctttgaccaacctttgtaccatgggcagtttgatgaaggttcaatcatattgtcaccgttgaagccagaaattggtacaaaagcaaccgattttgggttatatccaactttcttaataaaatttgtagtttccttgataatttctttgaaacgatcttcagcccatttagcggtgtccattttgttgatcgcaacaatgagctgcttaacaccaagtgtgaatgcgaggagtgcatgttctcgtgtctggccatccttagaaataccagcttcaaattcaccgttaccagcagcgatgattaaaatagcacaatcagcctgcgaagtaccagtaatcatgtttttgataaaatcacgatggccgggggcatcaatgacagtgacgtagtattttggggtttcaaatttccatagagcaatatcaattgtgataccacgctctcgttctgcctttagcttgtcaagtacccaggcatatttgaatgatccttttccaagttccgcagcttccttttcaaatttctcgattgttcgcttatcaattccaccacatttatagattaaatgaccagttgtagtagattttccgctgtcgacatgtccaatgacgactacgttgatatgaatcttttccttacccattttgtggtgagtgatcaatatagagaatttttaatgttagaaactgagtagttcgattacacagattgattgcttgaatcaaggtatgtggtgacagagaggaaagtaggaaaattggcgaatgtgcggagttg

SEQ ID NO: 564 - DNA, 551 bp, Artificial Sequence
  Synthetic
tgcaaactgcaacaagatttttacaacaaaatatcgacaaagtccatcataatgtcatcctctaaagtgaaggccggccaactctgggctaaaaacaaagccgaccttacgaaacaattaggagagcttaaaacagaactcggtcaattacggactcagaagattgctggaggttctgcttcaaagttaacgaaaattcacgacataagaaaatcaattgcaagagttctcacaataataaactcaaaacaacgttcacaacttcgattattttataaaggcaaaaaatacctacctcttgacctccgtccaaagcaaacacgagcgattcggagacgtcttacgaagcatgaaagttccaaaattttagacaaaacggccaaaaggctcacccacttcccccagagaaaatttgccattaaggctgaggtttagaatcaagataaggaatgatttatcttaatagagattaataaaaaaattataccaagacctcaaccaaattaaatcattggaatattgtaaatgtgatctttaattttggttatgtg

SEQ ID NO: 565 - DNA, 571 bp, Artificial Sequence
  Synthetic
cggtgtggcatagctgcaatcattatttacattgattttcacagtttttcaattgagttcaataagatatatgaagacagagaatcatgccgaataaagattgctcgaacagtttcttgttgctaatatgttactctatttattttaacatagttgcgtatatgatcagtatatttactcaagacttaataagagtttagtttcacatttattgagcggttcgttttcctttcgcgttcttcttaggggtatcggcgatgactaaatttggaggtaacgattgctttaatttttcaactttctcagagtcttttaacacaagagtgtataagtatttctgacagcgaactttgaattttgtctgagaagattttttgtttcgtttgatgcgtgcagatgaggcgtcttttcgtctgcagatctcaataaactgcttgatatccgaagtttcgcgtggcatcgtggaaattttaaaaactattatctctccaaagactctattgttgatggctgcttgcttcaggatgtgagggataacttctagctattatttcacttgtgggtgttcatt

SEQ ID NO: 566 - DNA, 448 bp, Artificial Sequence
  Synthetic
tttatttctagctacagcagagcgtgtttcgaaggaatttccgaacattgagtttgatgcagaacttctcgataatacttgcttgaagattgttaccgatcccaccccctataatgacaaagtccttgttatgcctaatctatacggagatattctctctgacatgtgtgccggcttaattggtggacttggtctcactccttcagggaatattggcgacaaatgttcaattttcgaagctgttcatgggtcagcacctgatatagcgggtaaagcacttgcaaatcctactgctctcctactctcatccattatgatgttaagacatatggagctggaaagctacgcacaaaaaatcgagaaggctatatttaaaacccttgctgaaggtaaatcactaacgggtgatttaggtggtaaggccaagacacatgaatatgcagaggcc

SEQ ID NO: 567 - skipped

SEQ ID NO: 568 - DNA, 484 bp, Artificial Sequence
  Synthetic
tgcaccctcttcgccaccagagacaccactcccgacaaatctgattccttttcctgctaaatacttggttctacggttggtatcaggaaaatgtgagttgccgccatcgataattatgtctccttgatcgaggaatggcaataatgtttcaataaaatcatcaacaggctttccagccatgacaagcagcataatacgacgtggtttttttagtttactcacaaattcctggatagaacgagcaccttcaatagatttcccttttgcctcattttcaagaaagtggtctaccttagctacagttcgattatatgcaataacattaaatccatggtctgcagcattcagaattagattctgccccatgacagctagaccgataaggccaaagtctcctgtagcagcactcatatttttttgattataaatttagaagcccaaagactggagcttatatggagaacagagattacacagatgggag

SEQ ID NO: 569 - DNA, 747 bp, Artificial Sequence
  Synthetic
tttttttttgtgagtaaatttaaaaattatttacctgaaaattatttgggactattttgattgggataaaatgattggtataattcaattatttcccataactaaagtaaaattaaaagtgaccctgcctagagacgacgaccacgacgaccacctttacgacgagtagaatctgacggggtaggtgtaacatcttcaattctaccaattttcattcctgaccgagcaagcgcacgaagtgctgattgagctccaggaccaggagttttcgttccatttcctcccgtggctcgtattttaatatggagagcatttatgcctagttccttacatcgcgcggcaacatcttgagcggccaacatggctgcatacggtgaagactcatcgcgatctgccttaactttcattcccccagttacacgagttatagtctcacgaccggagagatccgttatgtgtacaaatgtatcattgaagctggcaaatattcgtgccgttgcaaagacatttgattcaccttctcggagctgaggtccgagagatatattttcctgagcaggtcgagaagtctttttgggagccatgtatgttatgagttgctggtgcgaataagttgtacgtttcttaactgagaagacccgatatcaatatttcaatcattcaaccaccacaactattaattggcagtggtattttactactatcagatgtttctgatgagatggcctagaaattcatgacccaccg

SEQ ID NO: 570 - DNA, 571 bp, Artificial Sequence
  Synthetic
gtcgggtccataaatcataatgggactaagagcaggacaaatgctagacaactccacaaaaagcctataattcacataaccacaccagaattacttgcaatacgcggccatagttctgccgcctcctttcctacaggcccagttatagcagatcctttcatttctccctttggattgacaatcactcctgcgttgtcttcaaaatacaagaaaacaccatctgtacgtctccatggcttactttgtcgcacaattactgctggcataaccttcttgcggagatctggctttcccttttttaccgttgccattaccatatctcctacacctcctgctggtagacggtttaagcgcgcaccaattccttttactgagataatatacaaatttcttgctccgctgttatcgcagcagttcataacggcgccaaccggaagaccaagagtcatttttaacttgccaccaggggcaccacgagaaattttagccattgggaagttaggtgtgttttatttccctgtgtattaaaagtaagtcttttgaggctccattgaagaaatttctggaactg

SEQ ID NO: 571 - DNA, 2096 bp, Artificial Sequence
  Synthetic
agatgatatatgcttaaatagaagatttttcagaaaattggtaattttaaccactctagagcagctagttaagtcggcggaacaggcatcactattaatttgtattcctgattttccatgtttacatattactaaaatttacacatgagattcctccttaaagaaatccaaagttttagtcagatatacccatgttcttattgggtatgaatagctatcctctagatcaataatatggaagaataattcgattttaacatggagtccagctctgcataacaatgcttagatattaatcaagatcgccaaggccgagattctcttccgctttaataactcggagagtatttgtattacccataccacctttccatccttgtacgacgataaccgtttcaccttgatttaaaaccttcaatttcatagcctccacaatagcccatctaatacggcgatcaacattttcttgccagttgactttatcaaaatctggcttttcctcaggaaaaagaaatgggtatacaccccgataaagatgcgcatagcgagaagcagttggatttcgagtcaccatgaaaattggacagacaggccggtattttgataacaagcgagcactgtttccacttgtagaaagtacaattattccacctgcgttcatatccaaggaagcacgaacagcagacatagcacatgattcagtaatactgacaggacgttgagctaaactacatagctcttcgaaatgggacacatatgcgattgagttttcagctttcaagcaggtttcatgcatctcactaacagcttcgtttggataatttcctttagctgtttccccagataacataacacaatcggctccatcacttactgcatttccaacgtcactgatctcagctcttgttggacgaggattataaatcatggattcaagcatttgggtcgcgcaaataacaggtttaccggctatattgcacattgcaatcatttttttttgagcagcaaaaacttcagctgcaggaatctctatccctagatctccacgagcaaccatcacgccgtcagtttcggccaatatttctgagaaattgttgagaccctgtctattttcaattttggcgataatttgaatgttttttccgtcttcacctaggacacgacgaatatgtcttatatcctcgccacggcgaatgaaagaagcaaataccatatcaacgttgtttttgactccaaaccgaagatctgcctgatctttctcagataatgcagggagatcgacatcggtgtttgggagattgacacccttcttagaagatattttgccattatttcgacaacgtacacgaattgtctggtcatcgacaatttgaagaacttcgaaagcaagtacaccgtcatctacgtatatggttcgtccgggctcgataacttttgtgatattcttgtagtctacgtacatgtttttgtcgtcacaacatgctatatatttttcatcagtagtaaagttcatctcagttccagcggcgatggggatgtcctcatcatttacagtgttaccagttctaatttcaggccccttggtgtcaagtgcaatagcaacgggacgtccactttgtactcttacagcttcacgtgtattatcaatcactgattgatggtactcatgagagccatgagaaaaattcatacggacaacattcagaccagctcttcgaagtccatttaaggcctcgacattgttagttttggggccaatagtacagataatcgaggttcgacgataattcttagaggtggcatactcagtgtcaagttgtgatagccattcaatgcgagtagagctggttaggtgattcatagctgaaaccatattttgatctaatgagaacttttatttgatgtgaacgtaaatagttgaggatgtgtaaagttgaggagagagttggccaaagatactctttgagggtagcaaatttcgtttatcttattatttatgccacatccaagtgttggattgtgttagataagaatttagcaggggttacagctgcctcaacaaattgggagattatgagtcgtgaatttgacgcaac

SEQ ID NO: 572 - DNA, 985 bp, Artificial Sequence
  Synthetic
cagtaggtaaaatatctaaactatgatttagatgtatcatatgttttcaattttatgtttttaaagctatgtatcctcaagtaacagaattagaaaacctagttttcaaattgagattttggaaaaaatctaacaaccacttcacttggctccatcaattttggaaatataacttaggagatctaaaacacggcgagagtaaccccattcattatcataccatgatacgagtttgacaaagttgtcattgagcgagattccagctttcgcgtcgaaaatggatgagtgattatcaccgattaaatcagttgaaacgatgtcatcctcagtataagaaagtatgccttttaattcaccattggcagcctccttgatagcagccttaatttggtcataagtagcaccctttccaatgcggcatgttaagtcaacaacggaaacattagcagtgggtacacgcatagacattccggtaagtttgccattaagttctggaatgacttttcctactgctttggctgcacctgtgctacttggaattatgttctgagcagctgtgcgtccccctctccaatctttagctgaggggccatctacagtcttttgagtagctgtgtatgaatgaattgtagtcatgagaccttcaataatggtgaatttatcatgaataaccttggcgaggggtgcaagacaattggtagtgcaggatgcattagaaataacatcaacacttgagttgtatgtcttttcgttcacccccataacatacattggagcatcggcagaaggagcagaaataaccactttctttgctccacctttaagatgagccttggccttttctgttgtggtgaaaactccagttgactcaacgatgtagtaagcaccagtttcagcccatggaatgtcctctgggtttctttgagcgtagaacttaaccttctttccattaacaataagaccatcatcaactgcttcaattgtg

SEQ ID NO: 573-576 - skipped (4 entries)

SEQ ID NO: 577 - DNA, 1958 bp, Artificial Sequence
  Synthetic
tggacttgctgcatgtagaatactctactaaacgtattgaaaggtcgtcgtgctaaaataaagtgcgacggaaagctaccagcatgttcagcatgtgaaaaggctggttatgcgaagtcttgcgcaagtcctgttgctaaatcagttgatgggaatgaaaagagctatgtcgcatgtcttgaatctcgagtccgcgaacttgaagagaaaatatccttttccatgaaccataaaactaccttgaatttaaaagacccctcaaatctagtgaaattttcagaacgaaaagaattagaatttacccaaagcgcaccagcggatggaaagttagcaagaaggagagaagttgctgatgtgaataaacttgtatctgactttggcttcttatccattaatgctacgactcatgactttgaagaagctacaactagtatgacctttgcacgtcttattctggcagctgctactaatgaatcattacctgattatgggctctttacgttaccacccaagtccatagccagagcacttgcggattattacattgataatatcctgtgtttctttccaatttttgatgaggaaatattgctaaatgttctcgaatcaatctatcagcataacttacaacttgtatccgaatctggacattggttattctatatgaccttggcaattagctctataagtcaatcccgtaattacacagatagattctataaagatgcagtcatttgtattagaaaggcgttatcttttgcagatagggttctggtacctggatgtgtttctcagatacaagctctagtacttttagtgcagtactcaatgctcgatccagcacactttgatagttggatcctaaccggaattacttgtcgtgctattgtagatctagggtttcaccaggatccacctaaagatgagccaaccgatcagaagtctctggagctgaggagaaccttattttatagtatttactctcttgatagatctgtcagtatggttcacgcgcgctctttttcatttaccgacgattcgactagcgttactttcccatccattaagaacgagaaattaccagtcgacaccaaattaaaactaggtaggaaattcaagattcaatcctcacttttattcaaacttcgaaagattcagtcttcatggtatcacgagctttttcaatccaaaaatgattttataacaaatccatcaacatatattcagaaagtgtgtcaagaaatgcaagcatgggctcagtcgattcccgaatatttacccactcatatcaaaaattattttgatttagaactattatatagtttagtatattgtctggcgccttccagtcgagtgaaagtcgtgcctacttgggcaaagactttaaagtttgaatctagcatcaagtatattgagaaaataacagcaataaatcaagcttcatctaactttaccttttttacctaccatgatgcacttcgggtgtattttgttggaagtcaattcttgtctactcttcaagaagaacaggaatttcctgactattccgctatgcctccagattttcaattaaaggattttttctattcgtttcgaactccctgtgctgcaaacgaagataacttacatagggctttgtgttgtattattcagattaaggatattttgaagacatttagccatcgatggcaggactctagggtccttctttcatcagttgagcctcaattagactatttcgcaggaattttaggtcaaagaaaatgtcaacatgagtaactcgatattttgatttattaatagtgataatacatctaactaaagcccttttttgagaaaattatctaaagaagagatgtaaataaattatcttttgacatattttaacttggaatgaaaaaatccgacgaaatgaaactcctaagcagactcaattagttaatcaatataccccatca

SEQ ID NO: 578 - DNA, 2246 bp, Artificial Sequence
  Synthetic
ctgaatttatcccctcccccccaccactactccctctgccaaaaacacggtcagacatattggcaaatgcgatatttttctaccacctacgctctcaacttctaatttccatctagcgacgctccctttgctggtgactgactaagttggctttccgcccaagccttcaggttcttaccatttcattcgtgtgtatcgacgttcaaattcgcaacgcaattttcatttccatacctaaaatcctcctatctccctcaaattttgttcaccacatttttctagaaggaagaggcagcagcagcagcagcagcagcagtagcagtaaaagcacaagcacaagcagaagcagaaatagaaatatagagaaggagtgtgagcagaccagctggagaactctgatgctccaggagacacgtatggataaaattgatatattcccacccatgattgaggcctcacgcaccacaggtcaacggcaggacctccctcgtccttacaagtgtccactctgcgaaaagtcttttcaccgcttagaacatcagacaagacatattcgaacacatactggcgagaaaccacatcgatgctcacatccaggttgtattaagcgcttctctagatctgatgaattaaccagacatttgaggatacatatcaatcctaactcacgacgaagtggtaggatgccacagcagccgtcgacggtgagctcttcggtgttaaaaggcagagaaaggcatctatctatggtagcccctatgccttcccttcacaagattggttcgcggtcagccccggtatcaaccattgcctctccaaacctttcaccaacaacttccttttcatcttttgtacgaacagaaacgcctgattccagtctgccatttatagaaaatccagtggctagacaaaatgcacattgtagtagtaagagtgttggcaatggaaatggaatttttaacttggacatgaatcttttggcttctgctgctattagggtggaagggaatcactcatcaaacgcttgtcatctcccccgatacaataaatcatgctgcgacctcagtgcgtacaagagtcgttctcattttgcctcatcatcacttgttcagtctcatccacctccgacattagacaagctcaatcattgcattaagaggtatatgaagcgttcacgaactgactcccccagctcaactgccccatcatctccaactttttcccatgactcactttcacccacgcccgatgatacaccactagtaactccagctcactcaccacgccttcgctctcatggcagtggttacgatctcccttcacttcgaaccctctcactatatcagcaactcaaacctgctcttccacccatggagcctcagactttagattacattagccactcaagtccgtgtaacaattttccctgtgcctcagataatacgaaaactagctcatccctcagcgatatcattttgcaagcagatggaactcaaagaaaacttccttgtccgttattttacaagatttcccttcaagactgccaagggtctaatgaaaataaaatttcaagtctagtatcgggtagcttaactgggaacgatccacaagatcgaatggacattgaaaattaagcggggaacttgacattagatgtcagacttcgacggctaaaaactagctactttatagttttttttttttttaattatatatattttttatttttttctgttttgatcacacaatagatcttttttgcagagtctactcacgaacctacatgtgcgaatatgtgaaaggactacagtggaagggtagcgatacactctaactatcgaataaattctacatcaaattgacccctatgttctctctggttttctattttggatatcaatgtggagctgaaggatagggtggagaggcgactacggatatcgcttcttgttgtttgtttgttttttcctagtctgaagttaatggcctagcgcgtatatgaatggaaaaaaaaatgttatagaaacttggatacggggaagaaaagactggcgtcggtggtttgatatgatttgggttgtgttgagtcttgtgttatgcatgggggcgacggggtttcaagtgggcgctgtactcatagagtgggataatctaatatagacagacattcagacatctttctttttttttttttctttccatgaaaaaaaaacatcttaaattaaggggtgcatttgggccttgcc

SEQ ID NO: 579 - DNA, 1254 bp, Artificial Sequence; identical to SEQ ID NO: 499
  Synthetic

SEQ ID NO: 580 - DNA, 1254 bp, Artificial Sequence; identical to SEQ ID NO: 499
  Synthetic

SEQ ID NO: 581 - DNA, 1254 bp, Artificial Sequence; identical to SEQ ID NO: 499
  Synthetic

SEQ ID NO: 582 - DNA, 1254 bp, Artificial Sequence; identical to SEQ ID NO: 499
  Synthetic

SEQ ID NO: 583 - DNA, 1224 bp, Artificial Sequence
  Synthetic
agcttaaatcggcgactagtcatccgggtgagaaattgatgggaaaattttcactcaactacagatacacttaatctccatcgcttcttcatctccactacatttgaaattttaatttttaagacactcaactcactttaatataatcaccatgggtaaagatgctgagcctgttaagcagtctgttatgggagtgcccccattcgtcattgacttcctgatgggtggtgtatccgctgccgtatctaaaacagcagctgctcctatcgagcgagttaagttattgatccagaatcaggaagaaatgttaaaatcaggacgtttggataaaaaatatgatggaattttagattgctttaagcgagttacggcaaatgaaggtgttgcttcgctatggcgtgggaacacagccaatgtgatccgatattttcctacccaagctttgaatttcgctttccgagacacttacaaatcaatgttcaatttcaaaaaggaccgtgatggatatgcgaagtggatggctggtaatcttgcctctggtggagctgccggtgctacttctcttctttttgtctactcattagattatgctcgtactagattagcaaatgataacaaaagcgcgaaatcgggaggtgagcgccaattcaacggtttagtggatgtatacaaaaagacactcgcatctgacggtattgctggcctttatcgtggcttcatgccttcagtacttggtatagtcgtctaccgtggtctttacttcggtatgtatgactctattaagcctgttgtccttgtcgggcccttggaaggtaatttcttggcttcatttattcttggatggagcgttacaaccggtgctggaattgcttcatacccattagacacaattcgtcgccgtatgatgatgacttctggagaagctgtcaagtacaagtcttcattcgatgctggacgacagataattgcgaaggaaggtgttaagtctctctttaagggagctggtgccaacattctacgtggtgtcgctggtgctggtgtattatctatttacgatcagttacaagttctcttttttggaaaagcattcaaataaatcaatttgatttaaggtagacaggggtattgtaataaaatgcttggcgcatttggtataaaaattctggtaaactattgttagcaattttgacataataggactagtttactgctgtaaaaaaaaaa

SEQ ID NO: 584 - DNA, 934 bp, Artificial Sequence
  Synthetic
cgcgcgccgtaaacatatcgggatgaaattttttaataataaaatcaattgaaaataataaatttatatcctatttaatcaccgccaacaagaagttcgttttccttacctacctagaattagtttttagatatcgttcgatgtttcgtgaatttcaaatccagatgttgccgccgatttgttcttgatgcacctctagcgtatctccatctgccatatcgagaaactcaggactatcagtttgttgaacacgactcccttcaaataagaatcgaacagaagaaagtgatttcccttgcctctcacagaacgcgtccatcaatttcttaagtggtgttgttcgtttaattttgaagaagacttcattattgttatctgtaaccttgatatttaaatgttcacttggagctggtgcctccgatttttctggtgcgcttgagccgtcgtgctctgaattggccattctaagggaggatctaagttggctttttttttatttaaggcttttcgtagagaagacggatggctaaagagatcttaatttatcgtcccgttgctgtgatatagactattctgattgatttacttctcgtcagatatatgccttttataatttattgcttcggaaatcttgagaggtaatagacgcgattgaggggaggttcttttacatagtgaatatgtcaagaaaaagaatagatcaagaatttattccttctttgctttttaatatttttggggtttgttttaactcctttttctttagatattaattatggcttttctagtaatttttctgcatcgacgaaaaatgattggagatgagaaagggaagtagaaagatgcgaagtgctgtaagttcgtattctgggtagagtggaaatgcgaaagcaggcaatgaatttattaaatatggagagagggggggggtggc

SEQ ID NO: 585-587 - skipped (3 entries)

SEQ ID NO: 588 - DNA, 975 bp, Artificial Sequence
  Synthetic
tgcgcaaggaaaaaggctcacttcactggcatgattctttattcttccgaagctgcagcgccagtgataatttctaccagttcgccggtgatgactgcttggcgagttcggttaaacaggatttggtatttgtttatcatgtcacctgcgttctttgaagcattatccatagcgtttcgccgtgcagattgctcacaagcatggccctctgcaagagcccaaaataatgaatttgacagggcatattcgtgaagattagtgagaacttggtcgtcgacctcaaaagcagagaagttgggcgagttgattattgcttctacggagaaagcctgtataactgtaggttcgtagctttgagcattcaaaaatttgttgtaaacgattttagtagatgagtattcacttggcaaatgagagatttgatctgctattgtttgagcgtctgcaaaggttggaatatctttccctacgccagagaaacttaaaacaatatttttactacttgaccgactcaattgtgccttagccttctctcccaataccacaatatcggcattggggttttcagagagcatttttcgaacgtgtttacttaagcctgaatgaataccgccgcacaatcctttatctgagcttgcaactacaatcaagtacttttggtcatctttttcaacaggctttgttttggcttgatcgaacacagtaccggatgtctgaccatattggcgtgattcagtcatcgcacgttgggcacgagtgagttttgtggatgctacaatcttcattgtgtttgtaatcttctcaatattcttgatagatttaaggcgatcttcaatttcacgcaaagtagcaaaatttgcggtagaactcatagaaagaaatggagataatggagccgcagctctcaccattggccttaccctcattaagagcatgatgatataattgatcaatcagcaatgtaaattaggtaaa

SEQ ID NO: 589 - DNA, 913 bp, Artificial Sequence
  Synthetic
tttgcttgaggggcaaattttttcaaattgcctgtaacgcggtcatcgaaacgtgcaccaagtgctatcacaagatctgcctcctgcattgctaaattggcataagctgagccatgcatacccaacatatgtaaagatttttcatcaagttcgtcaaatccaccaagaccttgaagtgtcgttgtgactggaatggatgatttatcagatagttcctttaggagttgtggaccttctggactgttcacaataccttgaccagcatatatgattggctttttcgagatattgatcaaacgagcaacacgacaaatagttttctcgagctgcttacgtatttgagcctgagccaatttcgaggcctgacttggaagggttggaagggtgctgctcattggaatagcttttcgcaagattgaagccgttacgtcttttggtaaatctaccaagactggccctgggcgccctgaagtagcaatttcaaaagcttcattaattcttctcggtaattccgcaacatttttaaccatgacattccatttcgtacatgctcttgatattccgataacgtcagcctcttgaaatgcatcacttcctatggcagtagtgggcacttggccgcaaaaaactactagtggtgtaccgtcagatagagcgtcctgcatcggtgttatgacatttgttgcaccagggccagaagtaactagaatcaccccaggaagtccactagctctggcatagccttcagccatatgtccagcaccctgttcatgtttcggtagaataaaatcgaagtgccttgaattataaatagcgtcgaaaacgggaagaattgctccaccaggataaccgaaaatatgttttacaccttgccgtaacatcatttcgtgaaatatctctcctccggtttttc

SEQ ID NO: 590 - DNA, 1277 bp, Artificial Sequence
  Synthetic
cgataataccatttttgaaagaaaatcatcaccatgaatggtctacatgaaaaaataaaactaatttgggaaatgtacttgttataggtggctgcggctttcttggtcatcatatagttgatactcttcacaaatcctataattgtaatatatctgttctcgaccttcgcactacgcaaaatcgtcgtccagaaagtgatggtattcaatattttgagggagatatcacatcggtggattcaattttgccgatttttcttcaaaccaaaccatctgttgtaatacatacagcatcgccaactttgaccggtggctcgaaagaattatactggaaggttaatgttgatgggactcgctgtgttattgagacctgtcaaaaggccaacgtcaatgctttagtttataccagctctgctagtatcatatcagataatatgactgatctaatcaacgctgatgaaagatggccaatcattcccagcaaatatcagactgaatactattctgagactaaggctcaagcagaaatccttgttctcgcggctaatcgctcatcaagtcatccctcacttctcacctgctcccttcgccctgctggtatatttggcgaaggagatgtacaactaataccgaatatgcttaaggtttacgaaaactccaaaactggatttcaactgggggataattgcaatctttttgatttcacatatgtgggaaatgtcgcccaagcacattgtctagcagctgctgccttgataatgacttctcaactttcaacaacgcctttatcccatgagaaagttgatggtgaagcatttttcatcacaaatgaccagcccatttatttctgggattttgctcgagcagtatggaaatctgctggtagtgacaagggcacagaacacgtctgggaaataagccagagcgtgggcatgataattggtggaattttagaaaatttgctcatgcttatgggaaaagttcccagcttaacgaggaggcaagtacgatatagctgtatgacaagatactatgactgtagtaaagctaagaggctacttggatatacaccagaagtccacctgtgggaaggcatagagaggtcagttgcttggttcaaaaatcagagttaattatcgaagcccgaatgaatacttcatattactaaacttgcccgaattaaaattctggctagcttagttatcaaataaaaattgatagttaagttgatctttcattgatgaatatataagtacttaaccttatcattcaatgca

SEQ ID NO: 591 - DNA, 1698 bp, Artificial Sequence
  Synthetic
gttcggcaaatatttgttccgaccttgaagatacctacctaccttattgttcatattaagtagcaaacccaatcatattgccaacgacatttcatttctcttttcgaatttcattctttcctgggatttctcgttaaaagtggctcttatagatcaaaaacgagcagatcatggagccgttgaaacttactccgtttgaaactacaaaaatcgactcaatccctagcattgtcagtagatgcaaagctactttttcctcgcaaacaactaagccaattgaatttcgtcttcgtcagctgcgacagctctattggggtttgaatgattactctgcattacttgtggaagcatgcaaacaggatcttggaaagccaacttttgagacctttgtaacagagattgactggtgtaagaatgatattttattcgttactcaaaacttgaagaaatggatgaaagatgagccagcaccagatatttcccttagcaacttgcttgtcaagccaaaaataagaaaagaacctttaggaactgccctcgtcataggtgcatacaattttcctattcaactcgcaatcggtccattcattggactcattgctgctggctgtactggcgttttgaaaccatcagaagtatcaccagctacagcttcgatattgaaggttattttcgataaatatcttgaccctagtgcatttgccatcgtgaatggagctgtaactgaaacaacagctttactaaacgaaaaatgggacaaaatattttacactggcaatacccaagtaggtgtaataattgccaaaaaagctgcagaaactcttacaccagtttgcttagagctcgggggaatcaatccggcaatcattacgaaaaatgcagacccataccttgctgctcgtcggctattatggggtaaactaatgaatgctggacaagtttgcatcagtcaaaattatattcttgtcgaacaagaagttttaccaattttcgtagagcatttgaaaaacactctaaatgaattctatccaaatggtataagaaatagtccagattttggaaggatagtcaatcagcgtcatttttctagaattaaaaaaatgctcgagggaacgcgtggcaaagttcttcttgggggtggagttgatgaagcagaaaattacattgagatcacagttgttgaagtgcctgatacagatgacccaatgattgtgaatgaatctttcggaccattaatccctattctgacctttaatggtgtggatgaagcaatccggattgcaaactcgattcactcatctccattgggattttatccgtttggtaacaaagttgaagtagataagatgctgaatgaggtgacatctggtggtgcatcagtaaatgatgcattttttcatggctcgatttcaacgctagcttttggtggtgtaggttattcgggccaaggttcatatagaggtaaggcctcttttgatacatttactcacagacgctctgtcacgaccacacctaattggatggaacgtctacttaatgttagataccctccatatgaaggtaagctggcgaaactgcgtgcaatgaactcttcaaagcccaattttgatagaaattgcaaagagattaagaattttaaatattggtccggcatattgttcagcctaggaagtgattcgataaagtctgccttaatca

SEQ ID NO: 592 - DNA, 1000 bp, Artificial Sequence
  Synthetic
ctgtgacctctgttcgaaacacagaaagatttttcctcacgagcatgacctttttacagatgcagagctatcaaaacatatgaaaaaaggcgacaaaagtcctgcatctggcaatcaaactggctttaaaggtcatcctttgtgcattttctgtgggaatagattctatggtgatgatgagctatttaagcatttaagggagaaacatgagaggtgctttgtctgtgacctagccaacccagatatgcctccttcatattatgtaaattatgaagctttacatttgcatttcgttcaagatcattttatttgtaaaatgaaggattgcgtggatcaaaaatatatcgcttttgtttcagagtttgagcttagagcacacatgatcgaggttcatggtagttccctatctaaggatgatcttcgagatttgagaaatattgacctctcagacttttcctaccgacagccctatatgcaagaaagaagagacgccgttggccaaagaggaaacataagtaatagaggaagaggaagggtgagaggtataggaagggatccaaacgtggaccttccccaacccttaagtagtcaacctttaaggagggacgaacaagcatttcaaaggcaactagcagtccaatcctctcagtctgtcacgacaaggaactccgtccatcaaaatacaacaccagcatcgcaaatatcaaataatactccaaaatcacagtctcaagtaacaagatccccccagacttctaataaccttgaaagtgcaaacattggagcctcaaatagctcagagctgattcgagctagtaacaatccacgatttcgctccctaaaagatcaggctctgagtgaacgggcttctctgttactacaaaaagacccatcaaagatctctcaatttcaatcattcttcattgcttataatgatagtactataaaggctagcactttgattgataatttaatttcgcttttagctgatagtccatca

SEQ ID NO: 593-594 - skipped (2 entries)

SEQ ID NO: 595 - DNA, 1613 bp, Artificial Sequence
  Synthetic
caggactgtccagttagatctagagtcaaaatgcccaaatcatccaaaaagtaaggtggtataagaagaagcttaacgtttatagacgtaactgaatctcggaagaacagctctttcctagcaagcaagtagttgtgaaattacctgctcctaggtttattttttattttcaggtggaatattgatgatcgctggatccacaaaatgtaaattaaaaaaataaaaacaaatatctggtgactgaaggatttcatgtagtgactaaacgtcagtacaagtcacagagtactgatcaaaactacagaattatatctcgacgtcttccctgaagatgataaaagattcacccacaacataaagctttcattatatattggaggccgcctggtttgtacttctgacttctaccattacgttgttgattgttagggtttgattgcgttgtcatcctttgtggtaaatgattcgaactattttgaaattgagcctgagcagaaccaggtaaagtagcaacatcttgatatccgctgccacgttttggcattaaaccttgtgcgcttgttcgatcgcgcattctaccgataggaggctttgccatagctgggggtgctggttgggctgcattaagacgatctgaagtaagatatcttccaacattagcattgcctgtccttgatgcaccatggagatctttatttgacgctccctgaaccgcattttgctgataagatagatgacctgaagctcctcttgcttcccaaccttttccactgttaagtttcatccagtcatattcgccatcctcaacctcacatgtgttttttaaggcttgagtgaataaatctcttaaatagtcatagtccggtgtgtcttcaaatcctagatttcggacataatttaaatacttattgaattcttcagggaagccatcacagagatccttaatctgtgttgtttgcttcttctccccaattttttcatacttttgcttatttgttgctgcttttaatccttgccatggtaaaccaccccttagaaaatacatgaaaacgtgtccaagtgcttcaagatcatctcttcgagattgttctctccctaaatgtgtattaatgctcatgtatctagctgtgcctgataaagatttgcgttctctatatggtatatgctgttttgtcttgggttctcggtactgctttgccatgccaaaatcaactacgtgaatgacgttcgcagctttagatcctggacgtccaatgaggaaattatcaggcttgatatcgcgatatattaagttcttctcatgtattgtttgcactcgagaaagcatctgcttggccaccatgacgacagttttcgtgctaaaccttcgattgcaatgatcaaatagatcctctagcgaaggccctagcaaatcaatcacgagtatattatgaaggccttcctggccgaagtagtagacatttggtataccgggacaaccgacaagtattttgtatgtccgatactcatcccgtaactgtggagcatcactcttacgaggttcctaaaggggttgttaattcgaagtcataattaatcgctatcttcttagtttaagagtttgaaagttgatc

SEQ ID NO: 596 - skipped

SEQ ID NO: 597 - DNA, 1247 bp, Artificial Sequence
  Synthetic
tggtgttgagacctaagagcctatgagtgagtcacattacaacagaaagcctcaagtctaaagtcataacctattaaaattcgaaagcacaaaaacatccattaggaactgactaagtacaagagctactccataaaaatcagtcgcaatacatgtttttgcaaagcagatcaacctggttaagacgagaaataacttagtattcaacgtagctaaatctccagggtgttagtgtagtatattgacgtttccgaaataattaaaaccagcatcttagtttggtgttatttgatatatatgataagattcgtttaggatttattggaatttatttggctggtatctaatgtagatttgattgataccgtattatcaaatcattttatttctcatgatgagcaaaatcagtgtctacaagccaaatgacaaattataccccgaaaaatacctcaattcatttgtcgaatcaaggcatttattttttcttcacggttgccaagatcaccaccttcaacaaagtggcgaaactttcttgtcctaaagcctccagttggatttgagagtttgaaaggccacaggaaattagcagcagccttaaaattagggcctacggtgaaaatttcatggatcaaatcttcaatacagatgatgccgtatttacccaagcttttctcgacgatggagttatctgtaagagcaatacgctgtttgtcgacttttccgtagccacgcttgtatacaagttctcgaacagttttcagattagggtatccgtacgcgatccatggttcgactatcttgagcatctcaagtgttgctttagttaagcgtacaaacactccattgttgatttgtagtagccggagaagctgaaggatcttacgaggcttaggagcaattttattgatacccttgatgcggacaacaaacacgagtttattttctgcaggaatgtaaaaattaccttcctgtttagcgatacgagataatctgattttttctcgctcttgatcgcgatattctttgacgtatttttctgcacgtttgaaaatgacactacgcttctctttttgtaccttttttctcttttctaattcagcggctcgttcctcccttgatttttcttgactctttcgttttttgagtagagtctctgggacaagaatttggtcgacaaccggaacggacgttattgtagtcgacatatctgtgattgaagtgtttttcaacacaatgctgaattttca

SEQ ID NO: 598 - DNA, 1407 bp, Artificial Sequence
  Synthetic
tttcattatcatcatgttttgctaatgcaactgctgcgctttgtgattcggtcattattatgtctgaaactttatcatgctgccatggttcataagaaaaaaatttactaagattagtagggatgcatagacctaatgacacgcccataaaagttgtatggctatcccaaccatgttcagaaagtatctcgagaccatgaatgcttctagaaataaggccaagtacgaaaaatgcggttcctctcatgctcattatttcatgcgattctgcaattttaattatgttctgcacgacatctgatttttcaagaaaaggagcacccaattccatagatccaacgttacctacagcccataggcatcctttaaccttaagaataatctctaaatcatcataatgcattccatattcacgaatggttgaggcaaattcatcaaaatgacctttatcatgcaagagcttgcagccttcaacagtccttgttagctctcgataaaagtgaggaggtacatatgtatcattatcacactctagtcccaaactatctgcgtcaacactaaatcgattggatgattcttctgaagattcaataaaggcccgggccaagcttgcctcaattagcccaacatatgtgttatttcgtccaagaaaccaatcatccatttcgttacttatatagtctaggccatccaagtagtgatatccaattgaagttgagagaaaccttagcaataggggagcaccaatctctccaaggtgatcaagtgctggacggcattcaacaatatattccaagtcacttttatgattacacgcttcttctagaatcttaacggcagttgcacagacttcaatctcaggatcatataactgggtaacaagcagctgtatggcccattttgaatttccaacttgattctcgggcccatcattccgcaaatgacatgaaaacttacgcaatatatttgttgcataaattctgatctctttagaccctgcggttaaagctttggagaggagtacacgaggatgtcctggaagtgagtaatcaaaattagataatacaagcctaattaagtctgatcgctctttgaggtctataatatgatacatcatattcatcattcgccatcgatctagcatttggaggccgtttgtgtcacttgtcattgctcctaggattgcaaaataacccgagcataaagtttcttgtaagcgctctttagagaacattggagtttgggcagttagtccactagtcggatcacactgtgcgaggcattctgctagctgcctcaagagcttgttatctgaaagatatttgactccttcagttgtttgaagaagtgtattcatgagagcgcaccctaccttaatatacttgtgggatgatcgattatttttca

SEQ ID NO: 599 - DNA, 395 bp, Artificial Sequence
  Synthetic
ttgcaatatctagtaaaactcttttaagtcgaatagataagaagtattggctctatttgaaaagtgatcgaaatcaagatgaaaagctgagattcctcatgactttagataaagaattacctaaacatcttctttgtttctcctgtgcaatatatcattgtcggcttaatattggaaaagaacgccttaaatatgcatgggtcccgaatcctgtctacaattgcaatggatctaaaaaatttgggctgcagcagcccaagattagattaacacacggtcattttcttccttttgcatttgtacagcttgcaaccagagccgaaaagtacactattcaacacggtatcccattaattaatttgtgtcgtcgttacaaagaccgtaataccgattgg

SEQ ID NO: 600 - DNA, 1753 bp, Artificial Sequence
  Synthetic
tgaaccgaggagatttatatgatttatgatttcccaagttactaaatctaatctacgtaagaaaacgttgaggttctccaaacgccgaatgccgttaaattcattatgttgctcaagcccacccagccactaattttttggatacatcttttgttgaaatgacttttgtctccactgaccccataataacacaaccgagacatatcaaacatcataaaatccttctcccagatccatggttaaggtcaaatgttactatctattccaataaatacacttccatttagatcttgcttctattaattttgatagattcgagacttcctgaatttgagagaggccctctcttcattcagatgttattagacatgtgtaacctaaaaaattaaggttttaggcttttcccagctaaaattttgattcgtaaagtgaccattcttagctgtttgaaagtagataggctttgctagatcaagttctttcacgataacacctggacgtagatcaaaattctttcggataatctcaacgagctcgtcagagttcttttctgatgtgccatatgtatcgacataaatcgagagtggttcagcaacaccaatggcgtatgataattgtacaagcgcgcgtcgagcaagtttggcgttgactagtgattttgcaatccaacgtgcaacatatgcagcagatctgtctactttagaaaaatcctttcctgaaaacgcaccaccaccatgggctccccaaccaccatatgtatcgacaataatttttcggcctgtaaggccagcatcaccttgagggccacctataataaaaagtcccgatggttggatgtgatatattgttttttcatcaaggtattttgctggtatcacagctttaataattttttctttgatttcctctcttaaattctcagtagtgatagcttcgctatgctgtgcactgacaactaccgtgtgaactcttaaaggtattacagctccattatcgtgcttatactcaatagttacttgagtttttgtatctggtcgtaaccagggcaagcttccattccgacgagctgctgacattgcagcattaagcttatgggccaattgtatagttaatgggaacagctcaggtgtctcgtcagtagcatagccaaacataatgccttgatcaccagcaccaagtttctctagggcctcctcatagtgaagaccctgagctatatccggtgattgctgttctatggccactagaatattacaagttttgtaatcaaatcccttcgcagaatcatcatatcctatgtctttaatggcattacgaataacagattggtaatcaacgttggcctttgtagtgatttcaccaaagaccattaccatacctgtcttcgtagctgtctcacaggcgactttggacaagggatcgactgctaagcaagcatcaagaacagcatctgaaacctgatcagctatcttatcaggatgtccttctcccacagattcggaagtgaaaagaaaagttccagagttttgagccggcatagctgcaatagggcaaaaatttaagtctaattagtgtatgaaaagtgaggagacgccttgaagaaaaatatattctgtaaaagacttgaaaatgaaagtcgagatttgaatgaggggtaaagcagaaactagagctatttagctgccttgaggaataaaaactaagcggagatgctctaaaaataggcagaacgatatttgtggactggccatct

SEQ ID NO: 601 - DNA, 1303 bp, Artificial Sequence
  Synthetic
cttagattttcgagaatagaagtatgaaaacgagttgcttctgattatgattgaggaattaattaattttacaaatattgctgaaattagtaaaacatctggcgaagttagtctaatggctttttgccaatcatcagatacataggtgtaaataatccttcttttgcacctgccaccaagcaatcagctgccacagccatgctgtcagcagtttttcgagtgccacccggagcaattccaaaattctccaatattccaacaatcctatgtgtgataccacggccgacttttgtcattcgagcaatagtcggaaagtcccaaatactgcccatcatgctgaagtctccagcaagtggataataccatggagtaggatcaggtcgcagggccaaatcttcgtgatgcttaagttcgaagccagcggcttttatagcagcaataccgtcggaaactttcaccatatttgcaatgccatccccttgttctattccgagacgaatttctcgatgatgctgattatcattatcatatttgtcggtcataagccattcgtatacaccaaacgtcccaccaggcttgagcacacggaaaatctcgcgatacacctgttctagtgaggaggcgtggactgtagcctcaatagcatacactgaatcgaatgagttgtcaggaaatgacatttgcataaagtcacccttaacaaagcttaattggtttgataagccttctttctgtgcatatctcgtggcccgctctatttggtaatcattgttgttcaagccagtaatatgagcgccagtaaacttggcgatttctcttgccggaccaccaacaccacatccgacatcaagtactttgtctgcctcattaatgcctatcttagcggcaagataatgttcatgtcgcgcaatcgcttggtaaaatggttcaccgtaagcaaatctacagaagtgaaaagattgtccccagccgtattcgtaaagatcggtgccgagattatagtactgtcttgtcaaagtcgcatattctgctcttcgcgcctctctgtccttttctgtttcatctttcgcagttttgttatcccaatgcttaaaatactcatcaacagcagccttttgagcatccttgtctttcttcaacattgcacggaatccaccctcagcatttgaggaatccttatgcattgctctgttgaattcagcatcgcgagagtgattttcaggctctagtttcgtagtttccatgtcttaaaattctatagaaataagtttttagttgaaaaaagaggctacctgagttatta

SEQ ID NO: 602 - DNA, 1039 bp, Artificial Sequence
  Synthetic
ccgggaaatccactttattgcgtagtattgcgactggaaagcttgaaggctttccacctccagatattctcaaaacatgctttgtggagcataatcaaggtgaggatgcagatataagcatcctagagtttgtcgccaaagatccggagattggagaagctggtcgtgctcgtatttctgaagttttatctgaggttggcttcacctctggtcctagtggccgccaatcagaaaaagtgggctctctatctggtgggtggaaaatgaagctagctctagctagagctatgttgatgaaagccgatgttctccttcttgacgagccaacgaatcatctagatgtagcaaatgtgaaatggcttcaagaatatctgaagtcccattcagagattacctcattgattgtttcccatgactctggcttcttggacgaagtctgtacagatatttaccactatgagccaggtaaaaaacttgcctgctacaagggcaatctagcagcattcgttaaacagaaaccagaagcaaaaagctattacacactttcagcctctcaagttcaatttaaatttccatctccaggtattctttctggtgtaaaatctcaaactcgctcaattctccgtatgactaattgttcttatacttatcctggcgcttcaaaaccgtctttgcacaatgtgtcttgtcaactctccctttcatctcgaactgcaatcataggtggtaatggtgcaggaaaatcaacgttaataaaactacttactggcgagacggtccctacttctgggcgagtcgaaaaacaccctaatttgcgaattggatatataaaacaacatgcacttgaacatgttgaaatgcatctcgagaaaaccccaaaccaatatcttcaatggcgctatgccaatggtgatgatcgtgaggtacatatgaaacagactcgtattttatcggatgctgataaagctcaaatggaaaaatggattgatatcgatgggaagggagggaaacaaatcgaggctctcatgggtcgtcaaaa

SEQ ID NO: 603 - DNA, 3784 bp, Artificial Sequence
  Synthetic
ctctgcccatgaacgctttcgaaaagcaccacgcaattttttatgtgagtcagtcagatagtactcatgtctcatctcctgtttttcaatttgctcgtcttctccttcatgcatcagtcattccggtcggtcctacgatcttcgtaagactgactaaccaaattagccaaccattgctctgtgttgcgcgctgaattcttgcttcctgggtgccctcatatccggcttccctataagcggctggacgtaaatttctttacatcccacttcttaattccatcactccccaatccctcgactgccacgtcgctttggggccatattggggattcgtctgccacccaatatcgataagtcatatccgcttggtcgatatctcttttccggctctcttattttttattattatttaatattcaaaaaggatcatcagcggctccctcaaatcaagtcggagaaccccagcgatccattctgccagctattcgcacgtcagccctactgactctggattcttcgatgtggatgaccccgaatcaacaaagaactgggacgaggaaaaagtttgcgaatggctgaaaaatgtaaattgtggggaatatgaatcattgtttcgtaagaataatattaatggtccaaaccttctggagatggataaagtagtgttacaggaaatgggaattactaagattggagatcgagtccgattgtacctcaatatcaagaaacttcgagtaagatcgtattcaaaccaaaaaaaaaggggccgggaatctttggcaacattggatacactaacttcattttcctctgattcctcacgatatccaaatccggctagtcacctgagcaataatcagagttcaaataagagatattcaagacaatttgaaagttcaacaccaatttctgcaaatcctgaaaagtccgggaattcagagtccaggccgctctctaatcctcctgtagaagtgcgtgcgatacggcaacaaagaaaatactgttttctaagctctggagatgctacgaaaagggaaaatacatctacctcaaaaagctcaacatctaattctactacacataatgctcgaaggtcaagtacacctacggagttacaagtaaattctcctgtagttcgaaccattctaccccatagtcgtggaaatggaagtattgatggatccatgatgggccaacttcctcatggatctgatataattcgagtaatatcatctggtggagcttctaagacctttcgggtagccgactgtgcctcttgcgatgaagtaatgagaatgacgttaagaaaatttggttacagagaagatcatgatcgtaattattgtttttatgtcttagacggtcttgaccccgatccaagtaaatgtcgaagattatctgagagtgaactgtggagaattattaaagattctaaaaggtctgaaaggaatcgcctcattcttcgcaaaattcaccagggtgaaccaggcgatgctgaacttcaaagggcagcagctatagcggctgaagaaatcactgcgctccaaaatcgtcctacaaaaaatcttgaagaaaaaattacaccagttttacctaagattattagtgaacattggaagtctgactcaaatcatcccgcatcaccttcacaattctccaacatgacttacgaagaaaaggaacgagaacgaaatgtttgtagtgcagcaaaggacttagaacgacctccatctatcaatgagccatcctcagattataaccgtgtgcgatctagtgaaagacaaggagttctccgacaattctttggtgctagacccccaagtgaattaattacatcagatttaaccacatatttccctgatcatcctagagaagaaattgaccgaactgctcgactttcaatacggagatcaactcgcctcagtaaagttaatagtcgtcttagcgttgctagcaactttagctacgcatcaagtattgagaatgctcctccaatgccgacaattgcagatacatggttaagtggaactagccatgtcgctaaaataaaaccactagatctctctcggaacaatcccaatcggtatagagactccgttacatcatgtcttcttgaacctctacgagaagaatctatttcagaacccagccggaaatcatttgtttcatctgattatggatccgacacaactaatttaaatactaatgattctgattctcggacaagtcctagctactacgaagatgccgttccagaaatagctggctcgctacgtgatattagtcaagctttgaataatgatgacgaggaagaggatttagaacttcagagcttccttgccggtgactcatgggacgacagcaaatggatgaaaggtgctttgattggtcaaggttcatttggtagtgtctatcttgcgctacatgctgtgactggcgaacttttagcggtcaaacaggtcgaaactccatctccaggagcaaacagcgcaagcgattctagaaagaagagtatgattgacgcgttaaagcgcgaaataagtcttttacgagatcttcagcaccccaatatagtccaatatttaggagcaagctcttcaagcgattatttaaatatttttttggagtatgtgcctggtggctccgttcaaactatgttaaattcttatggcgcgcttcgggagccactggttcgaaatttcgtccgtcaaatagttaccggacttgcttacctccatggtcgtgaaatcatacatcgcgatatcaaaggtgcaaatatacttgtagataataaaggcggaatcaaaatttctgattttggcatctcgaagaaaatggaggccaccaatctacttggtggagctggaaatagtaagaaccgaccatctcttcaaggctcggttttttggatggcgccagaagttgttaagcaaacttcatacactcgaaaggcagatatttggtcattaggatgtttaatcgtcgagatgatgactggtaaacaccccttccctgattgttcacaactacaagctatttttaaaattggcggtgccaaagctagtcccgcaattcctagccatgcaagtagtgaggcacaaacattcttaaagcaggcatttgagattgaacacacaaaaagaccaagcgcagaggagttattatttagtccatttttaaaccgtataacatgagagttttttctaatgctatttttattctttcaaaaaagccctctcttttctccctcgctgtgttagcaaattggtaccctaaagtgacttggatatttaatagaaataattcctaaaaaaataaatgaaaccattatgagaagactctacgtctggcgttcaatttagaaagattttgaaaaattcaaattggcacttggtgtcgtgaaggtgtatgattaccaaatgtgcgataattagctctgttatgaagcgctatatactacacgataaaggctcttataatacagtcggaatttttgaattcagttttgcttaaacatctttgccttctacctagcatgggtaaggactgggcctatcactagcactagagaaaactgttttttattgaaatttgcatggtgacaagcgcttggtgacactgggaatcaaccaattaactatacaactgtatagcgggaaaagcattttatcttcgttttagtaaataaattagtattgagtcttatatgtgcttgcaactaaaagaccgatgcaatatatttcaagcttcgtgcttaccctcgtacttatcatatatagctatt

SEQ ID NO: 604 - DNA, 2668 bp, Artificial Sequence
  Synthetic
tgccttaatttttataacagaaggtagaaatcggagattaattctgttaccatcaatctaaatgttgtagcaacgaatgtgtgtaataatttgctgctagtaatcgtatgctactaaatagcatagcgcttatataacaatttctaaactagtttagttttccaatgtaagtcagtgagtgatcctttatgtaactctaacttctttatctattcgctgtaaccctcctagtatttatttctgcccaagttttcttccgaaaaatctaaaatctgagagattttttctttaattacgaaaaccagagttaggatttaatgattttaaagatatcaacatctcactttaatcccctctcttccaaatgccctgactcaaccaaaatgttaaccattaaaatcaaaatcaaaaattcaagcccaaatttagtatccgtaaagaaatgaaagttaaatgaattgaactgaacaaaaatttttggaatattaatacgccaacttatataaaagcgtaattaagagaatttttgccggacactcatattttgatgttctgtttaactagtattgcaacactgttgtttctcttaagccacttagccctttcattccccttcttcctaaaagagtggcaccttcgagattaagttcaaaagtggccttttggttccgtacttgttgtttggcagctgctgtgacagcagcgctatgttgaccgtagcctttctgctgtggaactcggttactattcaaatttgtctttcgcataacttgttcgacgtattgaagatttgattctttcgcctttggtgtttttgtttcatcactatattcggtttcatcattctgctcttctaattcatcttcatcgtcaatggggttaagactattgaattgaaaggttactcgttgacccccagccaaatttttgcgatgtttaacttcttcttcttgtcgatgtacagcatatccaacatcaaaaacctcacgaagattaattgcgcctggagagcgaaaatccattcgttttcctcctccaggagattccaagaattccggatgaaacgcccggagtgagcctccaagctgtttttgcctttcaatagcgggagttgctaaaggtggagcatcaggagcggcaaacgttggctctcgactatttctaatccatggatgtgctaagaactctttaatagtgtaacgctttgctggatcaactgtaaggagatgggagataagatcttgagccgacttcgagatttcgtcccaccatggcgatagaaaagtatattggcctttcgcaaccttttctgtgagcacttgaatactctcatcgtagaatggtgggaaaccacacagtagggtatataacacgcagcccatggcccacatatcaacactctttgagtatctttcatctctaacaatttctggcgcagtgtagccaacagttccgcacggtgtcattgttgaagactcccaaacaatcttgctcaatccaaaatcggctatcttaatctgtcctatgcctccagctccaactccaggaacaaattctccttcgtctaccttatcttcatcacctggagctttgggtttcaaaatctttgacggaatagtaggtattggacagtagagaaggttttcaggcttgatatctctatgaactactcctttttcttcatgaagatattctagagcacgggcaacctggacaataacatgtctagataaatcctcactaaagtaggtgagacggacaatttgatggaaaagttctccaccgggagcaagttctagtatgatgtagtaaaattgctctgactctgtgaagtcaattaatttaattatatttggatggtctagtccgcgcattatcgtgacctctttcaaaatgtttgctcgctccactacttttggtttctttttgaagttaggatgtagacgtgcttctccctgaatcgaattcatttcgtacttgtgtacaaccttgattgctacttccccaaactgaccttgtaagtctctcgcacgatatacattactgaaagcaccatcacccatcttttctatgagtttccatcgctcaagtcctgtgtaattcggcaacattcctttcatttcattctcctctgcaaccaggcgagccaagtcttctttatctattttgacaatctttttctccttctgttccactgaagttttagcatcccgagaagtacaaggggtatcagacctcctctgatcatcagccactctcgagacattgtcaagaggtttttgatggacttgacttgagtttatttgggtattgttagattgccgaggcacattttggtctaattcttgggcgttcgaacgagttacctttggaggctcagacgggacagttcgtgcttgctttccatgagccttgatgaaattatggaatttttgtgacaaagacatattacattcatttagtggtataaattttgaattagataatacgttgaatcaggacaaataagatatagtaactacgtggattgcaaggtctcctaaaatatctatagtgagtgaactgagcggccttgttaacttggattttcgggttgaggtcaatatcggaagtgttcattgggactgtctaggctgagataaatccggttcactaaatattgacgtca

SEQ ID NO: 605 - skipped

SEQ ID NO: 606 - DNA, 2345 bp, Artificial Sequence
  Synthetic
caattttttagcgagaagatcctaaccacataattcataagacgcccaattgcttttagatcaataacagaaataatacccaataaaatgaaaaataaaatacctgacccaaagatttggaaaacatggacacagaaaaactatttactagcaatttaatcaacctcctcaacagttggcccatcatcatgagaagcactaggggcaccacctgctcctgggaatcctgcaccacctggcatacctggcatacctgcagcgccagcgccagctccatcaccgtagaatttcatcattattggatttgcgactgattcaagttctttttggtggtcttcatattcctcctttgtagcggcttgggaattatctaaccattcaattgtcttgtcgatttgtgcctttaacttttccttgtctttagcgtcaagtttttcatcgaccttagaatcagtgagagtgtttcgtagagaataggcataggattctaatccattcttagcagtaatcctgcctgcttcagcttcatcatcagccttatatttttcagcttcggacaacattctctcaatatcctccttggaaagacgtcctttatcgtttgtaatgacaatcttgttagattttccagttcccttttcaagggctgatacattcataattccgtttgcatccaagtcaaatgtaacctctatttgaggtacaccacgtggggcaggtggaattccagttaactcaaatttaccaagtagattgttgtcttttgttcgttgtcgctcaccctcaaaaacttgaatgagaacaccaggttgattgtcagagtaagttgaaaatacttcagacttcttagtggggatagtagtgtttctaggaatcaatttggtcatctgtccaccagcggtttctattccgagtgagagtggtgcgacatcgagtaataggatttcatttgtggactttgaagatgtatcaccggacaaaattgcagcttggaccgcagcaccataagctacagcttcatcaggattgattgatttattaggttccttgccattgaaataatctgtgattagtttttggatcctgggaattcgcgttgatccaccaactagaacaatctcatgtacctttgatttgtcaattttggcgtcagctagaacacgatctactggggtagtggtagatctgaaaagatcttggcagagttcctcaaaacgagctcgggtgatggatgtatagaagtcgataccttcaaatagtgaatcaatttcgatggatgtctgggcagatgaggatagtgttcgttttgctcgttcacaggcggttcgaagacgtcttagtgctctagcgtttgaagataaatctttcttgtgtttgcgcttaaactcatttacaaagtggttgacgagtcggttgtcgaaatcttctcctcccaagtgagtatctcctgcggttgacttgacttcaaaaattccttcctcaattgtcaatagtgagacatcaaaggttcctcctcctaagtcaaagatgagtacatttctctctccctcgaccttcttgtcaagaccgtacgcaatagcagcagctgtgggctcattaatgatacggagaacatttagtccagcaataagacctgcgtctttggtagcttgtctttgagaatcattgaagtacgcaggcactgttacgacagcattgtcaacttgtgtacctagatacgcctctgccgtctccttcattttggtgagtaccatggaagagatttcttcaggtgtgaactgtttggtctctcctttgaagacaacttcgatgactggtttgccagccttgtctactatcttgaatgggaagtgcttcatatcagattgtacttcagggtcggcaaactttcggcctatcagacgtttggcgtcaaaaactgtgttggttggattcattgcgacttgatttttagcagcatcaccaattaagcgttcagtatccgtaaatgctacaaaggaaggtgtagttcgatttccttggtcattggcgatgatttcaattcgatcatctctgaaaataccaacacaagagtatgtagttcctaaatcgataccaattgcgggacccattttgaaatgaaaagtgtgtgtaattatttaaaaaggaaatttattgagcagttaagtttttaagtattgaagtgtgaaataattgcgattatgtgatggcgaaagaagggcaagctgctggctttatatactaaattaaaaattctgctcgattccatcatgttcgagagaaagacctgaatggagtttagcgctagcagcatttggaaggctgtagaatgtgctggattaccc

SEQ ID NO: 607-608 - skipped (2 entries)

SEQ ID NO: 609 - DNA, 1716 bp, Artificial Sequence
  Synthetic
actttaacagcgagttcaaatttccataccagaaccacttatatttcggtccttacttagcctcttctctacttcatcttgagaatagtgtatataagatatgtttaagcagccttaaaaaccgaatcattaaaattgtgtatatcttacacgttaaggcatttcttctcaatattaattcaagtttttctgcgatgggtctattgcctcagctcttgcgtctgactattagtccaaatcaattgagaccaatcttacaatggaaattgtggcacgaaccagtacatcgacgaaaccccgagaaagaatcgccaacgttacaagaatgcttcaaatacctttcattaacaagtcggagcttctcttcagtcattcaagagttgaatccggagctacttgttccagtaacgcttttctatcttattttacgaggtctagacacaatcgaagatgatatgacaataccaattgaaaaaaaggagccattactaaggaacttccatgatgtaattgggaaaaaagaatggaattttgatgggaacgggcccttagaaaaggatagagaacttcttgttcactttgatgttgttacaatcgaattcgcattgatcaaacctgtataccaaaccattattaaggacattacagagaaaatgggaaatggaatggctgattatgctttaaattcagagcaaaatgccaacggtataaatacaatcaaagactatgaactatattgtcattatgttgctggattagttggtgatggactgacaaggttattcgttgaaagcggactagctaatcctgccctactcaaacgtccccatcttacggagtctatgggtcaatttcttcaaaagacaaacattattcgagacgttagagaagactttgatgacggccgacgcttttggccaaaggaaatctggtcaaatcacgtggagaaattcgaagatttgtttaagcctaataatcttcaaaaagcactcgattgcagctcagaaatggtaatgcaatcacttcgtcacgccgatgaatgtctattttatatggcaggcatcaaagatcaaagtgttttcaattttgtggcaataccacaagctatggctattgcaactttagaacttgtctttcaaaaccccaaaattttcttagaaaatgtcaagattacaaaaggtgacgcatgtcagttaatgatagagtcatcacaaaatttacgctctgtctgtgggatttttaaaagatatgcccgtcgaattcacaaaaagaatagccccagagatccaaattttgtggaaattagtctagcttgcacaaagagatttattgaatccttatatccaacacaagatcctaaggtcctttctcttaagtatgaaaataagtcagcaaaagaaacagcagaagagtctgaagctaagaaggatgttctatacatcatgttggccgtatttggaacattagcagtgatttcagctgctatgattggagctgcatatattatcagtgcaaggcttggagtaacctttgatggattacaaagaagagtcaaagagtcacaagcactacctaccagaatcaatcgctcagagctatagatcttatatacttttaccaaatttttattttttcttgaaaaaatttgattccttagcttaatggcatgatttaataagcgttaaatagtaatcaaattcaatatttggatcctca

SEQ ID NO: 610 - skipped

SEQ ID NO: 611 - DNA, 1682 bp, Artificial Sequence
  Synthetic
ctacataggtcttgatctattaaatattcacgagtgtaaggtcaaattcctaatcttttgtctaatgaaatgtactgttgatttgattatgatttggtttgataaaagactaatatgatctaatttaaatcgaactgattgaaaaacatttgatttgcaatgaaaattaatatataatcaaataaaatcaaatatttctcactctggtgccggcccgttgtggtaggaagtgacccaactcttaaatcaggtcagcaacattcataggcatctcttcaatttgagtgctataaaactgctcaatttcacgcatcatccgaacatcatcagctgttacaaagttgatcgcaacaccttttcgtccaaatcgaccacctcgaccaattctgtgaatataattctcacgattagcaggcaagtcgtaattaataactaatgaaacttgttgtacatcaataccacgagcaagaagatcagtggcaattaaaacacgggatgagcctgatcgaaattctttcataataaggtctcgttgcaattgatccatgtcaccatgcatagctgacactgtaaaatcacgggcagtgagcttgtcggtgagccagtctacctttctgcgagtattgcagaaaattacggcttgggtaatagtaacagtctcgtaaagatctgataaagtgtcgagcttccagtcttccttctcaacagcgatgtaaaattgtttaataccctctagagtgagttcggcttttttgaccaatatcctcacaggatcgcgcataaaccgtgtggtgacttctaaaacatcatggggcatagtagccgagagaagtacgacttgagtagactggggaaggagttggaaaatatcataaatttggtcggtaaatccacgagaaagcatttcatcagcttcgtctaacacaaacatttttatagaatctgttttcaaaaaccgacgttgtatcatatcgtgaacacgacctggagtaccaacaacaacttgaggcccatcctgaagagccttcatgtcatcacgaacacttgtgccgccgatacatgcgtgacactcaacgttcataaaatcaccaatagctacaactaccttctgaatctgttgtgctagttcgcgtgtaggagcaagtataagggcttggcattgcttgagatttggctctagcttctgaagaactgagatggaaaacgtagctgtctttcccgtcccagactgagcttgcgcgataacgtcatgacctttaattacaggcattatagcacgttgctggatagctgatggacgttcaaacccataagcatacacacctcgtaaaagttcagatttaaggttcattgtgtcaaaagaatcaacagtctcatcataattggattcaatttgaccttcaggaatctcctcgagagattgatttttatcttcagaggccatgattgcggtgcggaaagagacttgatcgcataaaagttaacgattaggagttagtcggtcgatatgataaactgtcgataggtgagatggcgttgaatacgagtattttagaactctgaatattgactgtttagctaaaaaatcaaaaatttcgatatctgaacccgagggaggtatgttagatattattaaaattatacctgttcaggtcgagggaaaaaatattgttagacttagg

SEQ ID NO: 612 - DNA, 1307 bp, Artificial Sequence
  Synthetic
caaaagaacagtgactttattctccaaattaattagaggtctcgaaataacagagatatacaaaagtggggaattattaagcctagcgcataaaattgccctgtcatgagccatctcagcgtaaaatataacgactctagtatagtttgccgggtgatccacttttatttggcggatcctatgaagatggctaatcaggagctaacatcatgacatggactgcctcatctagcggcataaaccaccgaccttcaatgggattcccttgtattcatcaacctaaaggcttcgcagatagaaaaatagtaactagtcatgaagagatttatccttccatcttcacgtcttctgatttagagtcatcatcatcatcctctccatctaaagcccctttcgctaatctttcagcctcatctaatatatctttcggcacatgctcatgtcttcccttcgtcggcccatttaagctactgatccaagtcatttcaagctcaaattctttatccttgttatctgcatgtgctagatatatgatttttgcagcttcattgactccgtcaagtagacttagtgtgccagatgcaagatccaacttttccaactcagccttggcagtttgtcgtcctttaccagtagcagcaccatagtaaccccaatatgatccacttggctcaatcataaatagtcctggaccaccataggtcttaccctcagcttttccgcctgagccaatctctggaccacttccaacttcgctatcaacaggaatttcagattctgagtcccatccagcgattatagctgtgataccaaacggcctaacagaagagtaaagggtgtacaattgcaagtattgacccattcgattagctaaatcagcagtagagatgggacttttatagatttgtcgccaggaagatgcttcctctcgtgctctttgctcaaaatgtcttccatctggtataagtccagatgaaaccgtcccaatgtgccgatcgactgtcgcaatccgattgtttgctcctggctttaatagcttgctcgtaataatcttctcaacggcaagtacaaccccatctttacactttattcctatcgatgttcctccattttcaactgccttaaccgcgtattcgacttggaaattacgtccatcaggtgaaaaaactgaattggtaagatcataacccgtcccgatagatgtcatttttgcaattcaaggataagaaatctgcttcttccgatgggcaagtctgtgaaaggcccagaggcaggagtaactacgttgttggaatttaacaatcaaa

SEQ ID NO: 613 - DNA, 3008 bp, Artificial Sequence
  Synthetic
ctgcttttacgtcgcattagcgctcagggttgctgattttgagtacagagtagtagtaatctatttacatgaattacaagcttgtacggatgaatgtttgtcataagcctactcatctttcatggcgaatttcccaggcggctaactactctaatttgtgagaggcatgaaagtaatgatagattttctctatgtataataaatagtactcgtattttaatcattcaaaccctagtgatatcttttgtactcttctcttatcaaattacatcaagttcattccgtcatttctcgttatatatgacatataaagcattccattcgcatgatagaaaataagtaatatgtataatgactcaaagccttcaccccatagccaaaaagttgggtttatagtgaaacttgtgacgtagaggggattaatatcgcattttctatagcttcctttccagcaaaattgctatttcaactaattcattttaatggtttattataaatttagccagggctggacttcccatcgaatctgtttaacggagcagcgtgtaaagctggcttgataatctcgtctattttgccaatttttttcatctctaaagcattgatgacccaatcagcaacttctttgtctccttttgttaggtcattaaaatttgagctctccctatttccactgacttcaatatcttcattttcttctgaaatagtctctggcatagaaaatggtgcaagccagatatgttgcaatagcatagagtatttagggcgtaacataggcttcttattgagacaacttctgacaaaatcgcagatttggggagagaatgaatctttaggtaaagcaggaggttcaccatcaactattgcacttagctgtgagaatatattattatatgtttcgggtgggtatgggtatcttccaagtgcacattcgataattgttaagcctaagctccagatgtcagattgtacagaataagttccatctccagagccagtttgagctaatccaccgcctgcaatacgttcaggtgccatgtaagactgacatccaatattggtctttgcaatactggctactagatttccactgacaccaaagtcacagattttgatctggccacgggtatttataagaatattggttggctttacatcacgatgaatgatattgtggtcatctttgagggtttgaaggcccttaacggtagcatatgtaatttttctgaggatgttctctggaattccattaccataaattttatcaattgagcccccatccatatattcgatacaaatataaactgctccttcctgaaaaaaagctccataaaagtcaatgataaatggagagttacagcgatgcaaaatatcaagttccataataatagcagcaaatttggcctcatcaagttctaatcggatttccttcatagccatgactacgccagaagttgtattactgattcttgataaaggctcgggtgttacactatttttttcaacgctatttatcaatgatgctggagagggaactctacagcctgctagacctagtccaggtcttcgtacagtgggccgtgcatgtcgaactttatagacagtgccataatttccttttccgagttcttctagtgtatcaacctcatctagagagatgctgaaattacttccagaagtgaaatcaattccatgaccatgaattaccgccttcccgtcaaattttagcgttccgtttttggtatcgacatattcagaaaatttattgaacatagttggtgggcgttcttctttagatatatctgagatgttatttagggtcattttggtaggtgggcttgaaggattcgaaattcctgggagtcccccgaggattttcattcctcgtcgggcgctcagcccgcctttgttaggcatcataggtacgataggtgcagaaacaatgttatgaggttgcggtcgctgatttataggaactcggagatcagccggtgagccgctgattatagagcttggaaagtttggagagcttggaaagaggggcgcagacataagagggcgatttggcgttccttgtctagataagagaaatgatttcatcttagcttcaacactttcaggcaaagcaccgttgttggaatttaagcttgatcgaaagttcgaattactaactggaaaggtaggtctccgagcactgttgactaggtcaatatgagtggatggagcagagcttgaatttattatatctggactgctattcgatcgattatccattgagcgatggtagtttgattgggtgatttgtggaacaggataaatttcgttttctacaatcccttgagactcagatgtgagtgctagatctctaaggcattcggtagcgtaagatgaaatgtctgatggctcagccattgttttccaaaaaaatttaaaactctttagatttaagatgattaaatctgagtgaagccctgctacctcgtatgtttcaaacaaataaaaaaccaatatctcaatatcttaatataccaagcggtacgtaaaaatctcagatccggatgttgaggagtagctttaatactgaagtaaaaaatgttgcaattttgtgggacacaaattcgatgacaggtatctgagttaagagtggttacgttgaatgaacagttcgtttgccaagagtagaaatattgtgggactaattcttattacataaagcatgaaaggagaggggaaagattgatggtatgccttttgaacaatacgattctcggaaagctgacaaggagatgaagagacagcaaaggatgcctgtgtttggtggaaattatcaatattcttttccgcaaatttcaagttataaaagctgaagaatggccggcttgattactttaatgcaatcacatttaacttcgcgttacggttattaaataccaaacacgaaacacgagtctcctgtaaggcttttaaatgtggaaaatgatcaacatccgttgatggggttgaaaaag

SEQ ID NO: 614 - DNA, 1571 bp, Artificial Sequence
  Synthetic
tttacacgctctatgatatctatagtctttctgacccaaattctgtcataagttgaatcttattttacattactctactcactttcattttgggtcataggcgttcatgaatattgtagcagcagaatcagtgcaaaaaaatcatcatcccgaatggtcaaatatttacaatacagttttcattagatggacaactcactctcccataggattatcagaacttgacataaaaattgcacagtattgtgacgaccaagcaaaggaatttggagaaataacaacagataatacaagagaggatctaggtgcggataagaaattagttgataatattgtggacatagccagagattgttgtactcctaagaagtctacagtctcttgaaaatgttcgaaaatttttgggaaagtatatttgttagatattatgttctctcctaaaaaataatatcgatgacaattttgatttggtctcatctataaggtgagattctagaattttgtaccgcatgtagtacatcaaatcgacgccaataaaccagaactctaaaccattttacatcgagacttatagaaaaattctatctcatcaggctttctttttttgttttaacatctttctctcacgtctctttttcgctgcctcgggtcctgattcagtatccattaagtagtcccaccatctgaagctacttgaataattgccaatgaagcgctcatgatgaacatcgtgatgctcagctccagcccaaaaaggaaggaaatgatgtaagctccatgggaattcataacctgagtgagcatcaatagcttggaatagtcgacagataatccaacaatacatcgtaactaagtgaagattgccagttatcagacaccatacagttggcattaagactgttcctgcgccaagaaccattgtttctattggtgaagcatattcagctgctagtccgaagggtgcagagtaatgatgatgtattttatgaatatgtttgtagaaaggaccccaatgaaataatcgatgcatccaataatgccacgtatcttccaacacgaaaaagaaagcaatctgaagacacatagtttttaatgatggaaatgggacaccaacatccataccacaagcctttgtcaatggatgaaaaagccaaatttgaggcagctcgacagtgaaatgacttattaagaccagttttgtacattcccattgttctttggcagttggaattttctgaccctgaattttatatttgttgaaatatggtatatatcctatgatcacccatggaatacttcggccaaaataaacaagttcatgcataacaaaactcataataccagtggcgagagtatcattttgcatatattcgtaccaggacatccataagcgttccaaaatattgagatttaaagcattctgagaaatttctttatagatttccaagtaggtagttgggtttatatggacagtcgcattagtcgcgaagtccatagtgctaagatgcaatagagatgggaactccaaaggatttttaatgcttttgatagtgagcaaagaagttgcctgg

SEQ ID NO: 615 - DNA, 1475 bp, Artificial Sequence
  Synthetic
ctaatctgtaattcctgagggattcctcatattaattcgtgcttcttattgctcttctggacagtctaacatttatacatataaatattatgactcttgaatttggctctgaatttggcaaaaataaaaaccgcatctgtcatgaggcagatgttgttgtggttggcgctggcatctttggctgtgccattgcatttgctttagcaaatcaaggaagaagtgtttttttacttgaaaggtcattacagcagccggatcgaatagttggagaattgctgcaacccggtggtatttctgctttggagaaacttggacttgcacattgtttggagggaattgatgcaatacctgttcatggctatgaagttatttattatggcactggcgtgaaaataccttatcccaaggcagataccgataatgcgagtgctcatggatatacaaacattaagggcggtaatccggaaggacgagcttttcaccatggtagactaatatctcagctccgtagatgctgctcccagaacccgaacatcaaaattgttgaaacgctggttacagagactattacgaatcctcaaacccaaactgtaattggcgtaaggtcagagacaatgaatgataaaacaggcaaaagagaagccgactactatttgggagatctcacaattatcgccgatggatatgcatctaaattccgaaagcagtatatagacaagtcacccatcgtaaaaagcaaattctatgctttagagctgatagattgccctattccatctccaaatcacggaattgtgattctcggtgacaactctcccgtattactctatcaaattggaactcatgaaacccgcgccctcattgatgttcctagtaatactccttcagcatcagttgctgctggtggtatccgtggccatctccgaaataaagttctaccctctttgccaaagcaagttcaaccatcatttgaaaaagctatggaagatggcaagataccccgtagtatgccaaatagctggcttcccccatctacacaacaaaaaaaaggggtaattttacttggagatgctatgaatatgcgtcatccactaactggtggtggcatgacagtggcctttaatgatgtcgtctacctatcagacttactttcccccactcgcatacctttcctctccaatacgaaggctgtccaagaggctatgaaagaatttcattggaaacgaaaaagtttgtcaagtataatcaacattctcgccatggcactatattcactttttgcagcgaatgataaacagttaaagacattacaaaaaggctgttttgcatatttccagaagggtggtaattgtattgatgggcctgttggcttgctcgctggtattatcagacagccgatggtactgatttatcatttttttgctgtggcaattttaagcatttggatcactattactgagtcgataaatagtctt

SEQ ID NO: 616 - DNA, 1964 bp, Artificial Sequence
  Synthetic
cttggctcaaacctgttcagtgctcgctgtcatgatgataaatttattggtgattgttgcaattaaacactctctcgactaagaaattctgcctccttatcgatatctatcaacattgtacgttgtgaaggaaagcagtctcttaacagaatcaacttctcatttcaaagcaaataagaatcccattctcttcagctttgacatttccgaggaaggttatctatttgtggaagaagcagatagacccctattcctcctccccctctccctgcacataactttagccaatgagcttttctagggactctcttacactctctcccatacccagtcctctcacgtctcaccgtctcaccttccggtagaatagaatctttgaaggaatctcaagagtggcctcatcagctacagcgccattatctccattatctccattatcaccattactattttctgcgaccttctaatactccatcgttcatttgagcaacttttacccaagtttctatcaatcaatagaaataagtgtaattcaaaatgtcatctcgtgcgccaaaccccgcttcgggatcgcgcaagatctctttcaatgtgagcgagcagtatgatatccaagatgtggtgggagagggagcttatggtgttgtttgctcagctcttcacaaaccgtccggacagaaagttgctataaagaagataactccgtttgaccactctatgttctgtctaagaactttacgagaaatgaaacttttgagatattttaaccatgaaaacattatatcgattcttgacattcagaaaccaagaagcttccagacatttaccgaagtttacctgattcaggagctcatggaaacggatatgcacagagttattcgcacacaagatctttctgacgatcattgccaatattttatctatcaaacacttcgcgccctcaaagccatgcattcagcgaatgttttgcatcgtgatcttaaaccatcgaacctgcttctaaatgccaactgtgatctcaaggtttgcgattttggtctggctaggtctgccgcttcacaggaagataattctggtttcatgacggaatacgttgcgacacgctggtaccgtgcgcctgagattatgttgacttttaaggaatacactaaagcaattgatgtatggtctgtaggatgcatattggctgaaatgcttagcggcaagcctctgtttccaggaaaggactatcatcatcaactaacgcttattcttgatgttctgggaactcccacaatggaagactattatggtattaaatccagaagagcacgagagtatattcgttcgcttccttttaagaagaaaatcccattcaaacaaatgttccccaagacttcggacttggcactcgatctcctagaaaagcttttggcttttaatcctgtcaagcgtataacagttgacgaggctttacaacacccatatttagaaccatatcatgatccagaagatgaaccaacagcccagccaattccagaagaattcttcaactttgacaaaaataaagataatttgactaaggaacaacttaaagaacttatatatcaggaaatcatgcgatagtaggatatttaaaatttgaacgagacacaaaagacagcccgagttggtaacaatattcttaacaactcttttattaccagagaaagttgaaggagtcatatttaataagttttaagcacatggctggccagattcatgtctttagaaattgattcgagaagctaaaatttaccggttattagttcggctagagttggatatatttatcaatatatataaaatctattttgcaggaataaaatgatttggatacataatttatggtgacagagagaggaaggatatggatcttacaccgctctaccttaaaagttacaacgaaaataatttactcttgcgtattttgatttgaatttaag

SEQ ID NO: 617 - DNA, 1347 bp, Artificial Sequence
  Synthetic
tttctgcccgccccttcacagtatactctaacaaaagataatttcaagtcaataatatatttaccagagctcttgagtgcatcacattttcttacacaattattaatttgagatatctcataaatgtcggatgtaaaaatatatcaagctagtgctacggcgcctgtgaatattgccgtcgtcaaatattggggaaaaagagatcaaaagttaaatcttccgacgaattcgtcgatttctgttacactttctcagtcagatttacgagcgcatacaacagcatcgtgttctctcagttacagctctggagatactcttcttttaaattcaaagcctgaggatgttaccaatgcacgtatccaagcttgctttcgcgaattgcgtactcttcgctctcacgttgaatcatgtgactcgtcactaccaagaatttctcatctccccttgcgcatcgtctcgcaaaataacttccctacagctgcaggccttgcaagttctgccgccggatttgcagcactagtatttgccatcgcgaagctttacgagctgcctacatcttctacagatttatcccgtattgcacggcagggaagtgggagtgcttgtcggtctttattcggtggctttgttgaatggcagatgggaaaactggatgatggatccgactctattgcagtacaaattgcgcctgcttcccactggtccacattgaaagctctcattcttgtcatctcagggtcaaaaaaggatgttagctcaacatcaggtatgcaagctaccacaaaaacatcagagctttttaatcgacgtgtggaaactgtcgtgccagcaaatatcaaaatgatgcaaagcgcaattatgaacaaggactttgaaacctttgctaaagtcaccatgtcagatagcaataattttcatgcaacttgtcttgatacttacccaccaatattttatatgaacgatatttcccgcgcgacgataagattagttgaatatttgaattgcattttgaaccgtacagttgcggcctatacttttgatgcaggtccaaacgctgtaatatattaccaagaggaagacgagaaattagtcgttggacatgtaaaaggaatcctaggccacgtagatggatggcaaggaagaggtgctacagttagccccttaattaatgatggattcgatcaacgagccacagaactattgcataacggtgtcagcagggtaattatgacgggcattggcgatggtcccatcagcatagtggagagcttaattacaaacaatgggaaacctttgtgaaagtaaaaatattcgctggggcttcaacttcaattatttgccgtacca

SEQ ID NO: 618 - DNA, 1602 bp, Artificial Sequence
  Synthetic
attactctggcccttagaaatgtttgttcttgacaaaaatgaaacttttatggtgcctcagtttctttttcatatgggctggcctttgcttagaaacgccagatagaactaatgctacgtccccaacaccaagttgtgttacgtcgtgtttcgtcgagaatgtctttcgagaggccaaatgtgatataaatcaggttgcgcaatgtttatgtacaaacatagcattgcaacatcgtttatcaacatgtgtccaaactagctgcaattttgaagagcaaggaattgctataaatgagcaggctaaactttgtgctggatatcctcaggaatcaaggaaggcatatattatgaaagtggggatcatctttttcgtgataacgatgattgtcctcggatgtcgtctttacactcgttattcaaatacaggaaaactttgggctgatgattgggttgctctagtagctggaatctgccttgttattgttgcaagtctcgaaatatatgtttgtaatttagggttcggaaaacatatttggcaaattccaataacgaaaggtttgcaactcattaaacctttctacgccctccaatttctatacattgtggtacaagtcttggcaaagatttctttgctactaatatatcagcgcatttacccttcatcaaaattccaacttatctgcacaataggaattgcatttgttgcaacacatggcttggcgtttattttcacaatctttttccaatgtaagccgataagatctagttgggatccatctatgaatagaaattgcttgagtgcacctgctattggcttcgccggtgctggattctctattgttgaagatttggttataatatttttgccacttcctcaattgttacaacttcaaattagaacagcccaaaaggttgctttgattttcatgttttcaattggctctttcgcttgcatcacttcaattgtccgattaaagtatctctctacatttgagaattctacagacctaacttgggagaatactgatatacttgtatggtctattctcgaaatcgaagttactgtcatttgcgcatgcttacctacattacgtccactctttgttgaaataattcctggagtcttccgaacagctaagaatacatcatcaagtagcagaattactaatagtaatagtatattgaaacctaaattaactaaattcacatttaacttgaatccccggaactggctcaggtggaagaataaacacaagacagaatcggaaaaattgccagtctgcgaaaaatcatggagttcggtgccgggttaaacatgggagtaactttgatcagatcataacactaattggatattttcttgtttacttttctaaatgttttgttcacgtccatcctaatgggatgagaaaataatctgtttcatttcgtcgttaaacctatcacatgttcgtcgatcatattaaataaacaaaattaattttataatacataatttaaaatatcactagagacaaggtctaaaagcgtcatatagaaaacaaacaagcaatactcctttttgctgagtttaacatgacatcgtatagctttgtttttcaa

SEQ ID NO: 619 - DNA, 1722 bp, Artificial Sequence
  Synthetic
ttcaaattgataataagcttcttttctctagcacttacgagcacgtctctttgaattcaactagagactcacaattataccttcctcctattaaatctttagtattggatacgaaaaatgagggaagttattagtgttaatgttggccaagctgggtgccaaatagcaaactcttgctgggagctctattgccttgagcatggtatacagcctgatggttacttaacggagaagcgcaaggccgccgaacctgacgaaggtttcagcacttttttttcagagactggtcagggaaaatacgtacctagaactatttattgtgatcttgaaccaaatgtagtcgatgaagttcgtacgggtacttatcgtagcttattccaccccgagcaaatgatcaccggaaaagaagatgcatcaaacaattacgcccgtggtcactatactgttggaaaagagttaatcgatcaggtgttagataaaattcgccatgtagcagataactgctcgggccttcaggggttccttgtttttcactcttttggtggtggaactggttccggctttggtgctctgttaatggagcgactttctgttgattttggtaaaaaagtcaaactagagttttgtgtctaccctgcaccacaaactgctacctctgttgtagaaccatacaactctattttaacaacccacactactctagagcactctgattgttcttttatggttgataacgaagctatttatgacatctgccgtagaaatctcggccttgaacgccctaattatgagaatttgaaccgtctggttgcacaagttgtttcttcaatcactgcctcgctccgattcgatggctccctcaacgttgatctcaatgaatttcagaccaacttagtcccatacccacgcatccattttccacttgtggcctactcccctgttatttcaactgctaaagcatcgcacgagtctaactctgttcaagaaatctcaatgtcatgctttgagcctaacaaccaaatggtcaaatgtgatccgcgcaatggaaagtatatggctacatgtttattgtaccgtggtgatgtagtcccaaaagacgtccatgctgcagtcgctacgcttaaaaccaagcgtactattcaatttgttgactggtgcccaactggctttaaaattggcatttgttttcagccacctcaaatggtacctaatggtgatcttgctgatgttaaccgagcagtatgtatgttgtccaatactacggcaatatcggaagcctggtccgctctctcacataaatttgatctcatgtactcaaagcgtgcatttgtgcactggtatgtaggcgagggaatggaggaaggcgagttctctgaagcccgtgaggatctggctgcactagaacgtgactatgaagaagttgcaacggattctatggagggcgatgacgcagaagctgaatactagaacttagtgaccaaaaatatcattcagtctatttaatttcgaacgattgcattcaatctaacttggagtagagacatacaatataagatgcatgaggaggttgccattttcagggcagtagcatgggaaccctttctgatctttcatttcacattacttcgcaagactgaaggatcatgtgaatcatgagagctaataatcttcttttttattcaaaatacataattatcaatttgtggtgtcgcaacacgtccg

SEQ ID NO: 620 - DNA, 1380 bp, Artificial Sequence
  Synthetic
tgggtcttttacattattaaaaggacgtatcatcacgactattgtcctgactaaactatataccatctgctaacacgatcctcaaagcaaaatttttaaccgatgatcataagtcatgtaaaagttgaaatttcaacacacaccaagaaaaatagccttggtctttcaatttacagcatccatatggatgctattttcttatatatttcacctacctcctgagaactgcatcaagattcgaggtcgtttctttatataatcatgtcaaataatgcatgataaatgagtaagaggctctaggcagtcaaactcaaagaattgtcttcaattgtattgtcattttatctcatttgataatgagttgtagccgcaactcaaatcatttttcattttttgaaaatgaagtaaaagaccggtttaaaaaattaaatatctctcatttcagtatcgtcactcagaacttcatcagatggcccccaattgccttcatatactgttgcaccagccctacgccttgtttcaacccataaaaccccttcagattgaagtaattcatgaacaacaggacgatgatttggattcggtgtgatcatccaacgtaccagttgatcaagcgaattttgatggtacatgtctgtcataaaatttggagctttatgtaactcgcctctacgcattgatccaaaaagattgcttgggtcatgagataacgatctgcaagacctaccataatttcttcgtcggccactaatgctaggtgatccaaattcagtttcaatgtcgtcatcactgccaagtgatcccaaagctaattcattatcatcaatcggagtaccggtagcatcgcgtcgagtatgattgtcactgctccatgtcagactagggacatcactgacatcgcctgatcgaagccgttgccaagtaggcccgttatccggaagttgtacattgcccgcaatttcaagcatcataaggccaagtgagaatacatctgcaggcttatcatatattccctcgaggatttcggggcctatatactcgcgatcaccttcaccttcaattcctggttgtgcaggccaagcggttgctataccaaagtctgcaatttttaaaacaccctcaaatgtaataagaacattagcaggtttcagatctaaatggatgaatccaaaatcatggatatgtttaagaccaagaccaagttctaggaggatcttccatatcctgaagtcatctaatctgccttttcggccaacctgggaaagaaataaatccatacttccctcttcacaaaactccgtttggatatatagatgatttttatcttcccaagtatccaaaagatgtacgatatgatcagagtgtccaagtgcctttaat

SEQ ID NO: 621 - DNA, 851 bp, Artificial Sequence
  Synthetic
tatattcagatttcggatctagcacatatgtacagccacattattgtggcaaataattttatgaccaaactctcagtatataattttaagtctataagattaccacatgtatattccttgggttcaatattagcatataccaaacaaagatcataggcaaattttgtcaatttcaacaataacactcatctctttagttactgaaaatggttgttttggcagcttcgatttgtacaagaggaggaaaggctgtcctttctagacaatttcgggagatatccaggtcacgaattgaggcactattagcttcactcccaaaacttgctgacacaggaactcagcacacaaccgttgagcaagatagtgtccgattcgtttatcaacctcttgacgagctttacatggtacttgttactaatcgtcaatctaatatccttcaggatattgataccctccacgtgttcgtacaagttatcacaagtatctgtaagtctctagaggagagagaaatactgaaaaatgcgtacgagcttttaagtgcatttgacgagattgtctctcagggttatcgtgagaatctaacaatcaaccaaattaaatcttttttggaaatggaaagccacgaggaaaggatacaagaaataatatcaaggaataaagagctagaggctaccgaagaacgaaagagaaaagctaagcaattggaaattcaacggaaagaggcttccaggggaggcagaactacaattcctcgtgctccagtctaccctacatacacatcctcaactcgttccccggtcaccgatacatacgatgcctatgaagcagaaaaaaataagtttaaagccccg

SEQ ID NO: 622 - DNA, 1372 bp, Artificial Sequence
  Synthetic
attttcttttatccgagaagacattaaatctttagaaaatgtttgctgcacggagaaccatttttaactcctcattttcggctaggagggctttcacagtctctgttagagatttaaaaaaagtcgcagtactcggtgctgctggagggattggacagccattatcactcctcttaaagcttaatccacgagtcactgatttagctctatacgatattcgacttgcacatggcgttgctacagacttagcccatattaataccaagagcactgttactggatatggcccatcagaagacggactcgccaaagctcttagcggttcagagattgttctgattccggccggtgttccacggaagcctggaatgtctcgagacgatctattcaacactaatgcttccatcgttcgggaccttgcaaaagccatttccatatctgctcctaaagccaatgtacttgtcatctcgaacccagtcaatagcaccgttcctattgtcgccgaagtttttaagaagaataaaacttacaatccaaaaaatctttttggtgttactactttagatgtcgttcgagcatcccgctttgtttctgaaattaaaaatactgatcctgataaagagaaaataactgttgttgggggacattctggagtcactattgttccccttttctcacagtcatctcatccagaccttgtaaatgacaaaaagctactggaacgtgttcaatttggaggtgatgaggttgtcaaagctaaagatgggtctggatctgcaacactatcaatggcaatggcgggtgctcgatttaccgacagtttattaagggcaattgaaggagagaagggcattgttgagcctgcttatgttgatagtccactttataaagattcaggaattgatttcttttctagtagagttgagcttggccctaatggcgtaaataagatccatgaagtgggaaaccttgctcctgaagaacaaggtcttttaaaagctgctctagttgatttgttaaagaatatcgaaaaaggaatcaaatttgttaaccagaaccccggtgaataaataaaatgttattcaatttacaatctgttgttttttgatcgtggataccttgatattcagtaacgagggagaatcattctcctgtcccaaaaaagtactatctactatcttaaattttatggaatcttgaatttgtccaatgtatcaatagaaaaattctttcaaattacaagtcaaaagtattatgaaaattaaaaaggactaatcctcttacatagatatatataaatatatacacaccttctaatatgttacttttaattcaaaaaaataatacggggctcttattaagttaaaatgag

SEQ ID NO: 623 - DNA, 3083 bp, Artificial Sequence
  Synthetic
taaaaatgggagagatttaattatttctcaaactaattgattctcgggtgctaagcctggtcaatctgtcataggcttcgccgtctcccggcaatctaccactctattcatttacaaagaggcaatctagtgggtataaaagttcatggtcacgtacgctcggaatctagtgccgccatcaccctgccaactcgttatttttgccgccttccctaaccaaaaagcccacattacatataattatttagtgaataaaaaaaaagaaatccataatttttaccctattcctccaatctaagctccaaaatccatccacattacataaaatagtattatagaaagtagtataataaatagtgaattaggactcaagaattacttttctaggccaccctgcctctacttcacctatccatctcatatcggttgttgcagtagcgaatgactgttcatgagatcactcgacatcccagaattcgacattggcattgtcatgcctaaattactcaatcctgagaatgtttgattaagatttgtagaaagaaacccattttcggataacggcgagtttccgtctagtgcactgaatgtttcttccccttcatattcttcttccccttcactaaattgaggaaaggtaccttcaatactgccgtcaatacggtcatgagttcttttatgctgtgccaaattatccgaccttgaaaaggctttattacaatgagggcagacatatggtctttcttgagtatgagttctcacgtgtcttttcaagtgctctaaacgtttgaaaagacggccgcaggttggaataggacatgagtgagatttttgtggataagggcctgactccatcatcgtagcacttcttgctcttcgtattgcagaagcagagctatgtaactgggatctaggagagtcatgtattgagggtccaccttcacatcccacaacctcatcattagtcaattgagaatattcattgtgttgcatattaattgaattgattgctggactgccttcgatactagacataggagtaccatgtcgtgaagtatctattaaatctttgtgttgcgagatattatgcggtccgcgactatatctcaatccaggaggtgaattattttcttgctcatccgcttcggttacaggtgcagaggtagagactgatcgtcgaagatcagaaggacgatgtgagccgtgattttgagtagtatttgctgataaagctgcagctacagggggtatagatgagcgacgtcgtctctgcttataattaggggagccttccatcacagagtacgtattatttccaccaaaacctcgactagcatgtgagaaaggtgacccggtcaaatttgaaggtgggagatgcatcatgccgttgagagccccgcccatatgatcaggtagagcagagtaaaggccagtttcttcgttcgcaatgtaggccgattctgatcccatgcctagagattgctgaggaggtgttatgggttcaaacgaaatcccacgattactgtaatcttcaaaatgggatgacacaaaggatggagtcggggaatactctaatgaatagctaggaagagaggtgtgacgttgttgagcttgtaacattgaaattccattttgtgtgtatggcattcgtccataatcattctcccttttcaccacttgttggggcatgcttgaaattgacatttggtggtagggtgccaaaggattcatatcatcaggtatagagagaggaattatctgcggtggtggcatgacatctatcgagcgcattaagggtgacttgttttgaggtggtgcatatgatggcatctgagcggagaatgacgaagaatttgtttgttgtgctttggtgagttgttcaaacaaagactgtgatgaatcaaactcaaaggatagagcaggttcactaacagccacggtagttgcttcctgtcccatcttctcccttttcaaatcccgttctaatgcatctaagaaaaggcgatcatgtggaacactataccagtaaaatactttttgtttcttttgagtcctaatacagttattcttataaagaaaatctaagaatccactctttggctcctcaagagaagcatcagtacccgacttcaaattacgcagatcagaaaatattccttcctcaaattttttagagtttttcaccggacgtccaaaagcttggaatcggaaagaaagacatcgcacaatgtcggtaccagagatatgaaagaggttattccagaggacacaagaaacgtattcaccggtaggaagaaggaaccgtcgaatgtattggtctggagtccaatcgacgggggctgagagtaggaaatactttaagttatcaacctgctgtaaagcaacttgggcatcttgtggcagtgattgctgggcttcgctacttaacatgaatgtctctggtttttggggcggtgccatagtggagtgatgttgtgaatacatcgtgggggccagtttctcggtgagtatcaggtgtataaataaaacgtataaaaatgtgatgttatagatcgacggtcaaagatttctagagattgaggtactggacattccttcttcaacccctcaagaaattgttaagtcgaaagattagtaattctcaactctgattaaaataatcgatatgtatgaagataagcgagatgaattgataatgttgtctaaaatttcgaattatgaatctttacaaaagagggtgagttgtcgtatgataaaaggagcctgctccgatctagatagaacacagcaggtaaagtagaagtgatatctgcgaggagccttgacaccagcaaggactcagtccgaagagtacgagttgctttctggtttgttgaatgaaagaagtagaaaaaaatataatgttgtgaagcccagcgattagagagtaataatatttaacaacaaaaaatgacatctaggcaggaggagtggtggatgtcaagtagatgtgtgagttttggaagggagaaatagaggtagaaaagcgtggagggggaaagcacgtaacgcacggatagtgcgaggggagggcagcggcggtg

SEQ ID NO: 624 - DNA, 656 bp, Artificial Sequence
  Synthetic
cactaagagatgaattacaaagaaacagacagatgattttatcatatttcaaggtatatttgaatttagtgaatctagtttaatataatttaaatttattcgattatcaccaacctatgaaaaaatcatttcatcccaattccgacatgaatttgtagtgtctgacaggtttgtttaaaaacgaagtggtgtaaagaaccatcgattctttccacttaaatatctctcctctaaggctttcttaaccactttcttggcatcctctcgctgcgatacttccttgaatgtttctgtagatattacgtttttaagaccttctaattcgagtgtgtaacgtgttggcataatatgattataattgataacttttataaaaggctttactttgctgcgtttggcctgacgtgtttttgacatgcgacgagttacttgtaaaggatatctttcaatacctgcgacgagggcatgaggatatggatgtgatttatttccactatcaaaaggctgaataataacgaccttctttcctgcatatctgcctctagttataatggcaactcggccgaccttgaggaacttcatttagacttaactggtgttgtcgaatgtacaatgttgttcaaaggatgagacaagtacttgaatcttgaattcgg

SEQ ID NO: 625 - DNA, 1950 bp, Artificial Sequence
  Synthetic
ctcgggactaaatttcttgacttatttgttagcttagaataataatatcagaaaatgatcaattccctaagaatacgtagagaataaaccagagggcggtagtcaatgattctcaaattccataaattctttaaaaccctcttacattcacggtcctatgtcatgtaatgagtcatatctcagcccgtcagttggcatttctgggagttgcttgattttcttatctatcgatgaactcatggttcgtgacgatgtatttctgtttagttcgctggaacgtagaatgttacaccgtaatatcttggaaagctttcatcacggcgtagtttttagctatctcggacacttctactagaagtcaaattctttaaatccatgtttgatctcatacttagcttggagaacttgttgtctggatgacattctatccaggcccgcattccctgaatcaacttgctgttcagagctcggagcaatcttgcgtagcataaacattggttttttgccctctttatccagctgcttgaacaaaataagtggtttctcatccatattgagacaacgttcattatcgccgtacacaatgtataaggcgtactgctcccagggtgcatttatattgtactttttaagggctgcaggtaaaaccttgtaacatggatcatccatactaactctaaaagatttaaatatttcaacagagccaccggaagaggaattgtcaatggttgttgcttgtacacgccttgatggtgcagactttgtattatcacggccttgagaaataccttggttctggtctccatcaagttgtccaaaattactgcgacttggtatagattgatcagagcgataggatcgagagccgagggtagagccactacatggctgtagaggtgaagtaggtgaaagttgatttggcgatggtagagatgagttactattactgatagaaggtaaatttgagtaagattgcaaatttctatcagacgcagctgactgatcaagagtttgctctaataaggatctttcatgagctgaatgcgcatatgtcggtgacaaatttttgggatgatcgataaagaattttttggttgaatagttgcgagagattccaggttgtattgcaggtgatgaagaagctggtgaagaaatgttgcttgagttgtcaaaattgctactgtttgaaccatttgtttttgcggaaggatacgggagtggtttaccttcttttgccatccgaaaaactggaagtaaatcctctctaagtcgtgtatattcgaatgttattctccttaattctgactctgcagctgtcatccgctcatctcgtaaatgaagttgttcaactaacagcttaatatctttcagtgttgcagccgcagattgactttcagcttctgctgatagcggaatgtaatgatcattttctatgggtatttcctgtctcacttttatgtcgtatacacttttgaggattgtcagtcgatggccaacactagtaacccccatttgttttaattcatcatgttgtagagccacaagtgcttcaccaacaatttcattttctaagaattgatccccatattgatgtaagcctagactgctcacaaaatccgcacactcatctgcagtccactgcgtaataatcgtctctggtaacttatctcctgatatatgagtatcataggtggtaggagtatgatcattggagaataagccctcagagtccgtcggcgatgcttcactgtccgtggctatgacaagactcgaccgtacagagcgctcatactcctcgtcaccatcactgtctgcaaaagctgtcccagattcaaaagccatactgccgttaaatgtactcacaagaggcaggttgtcgtggtaagtatagtatattatggacttaattgtgaatctgtagctcttactcactctaggctatggtctgag

SEQ ID NO: 626 - DNA, 2117 bp, Artificial Sequence
  Synthetic
tgtgagcccagtcgattactacaccaataccccgcacgggaagacgccaaagctaagactagactagatatgtcttagccgttaatgcaaatttttgcgactacatcaactccgcacattcgccaattttcctactttcctctctgtcaccacataccttgattcaagcaatcaatctgtgtaatcgaactactcagtttctaacattaaaaattctctatattgatcactcaccacaaaatgggtaaggaaaagattcatatcaacgtagtcgtcattggacatgtcgacagcggaaaatctactacaactggtcatttaatctataaatgtggtggaattgataagcgaacaatcgagaaatttgaaaaggaagctgcggaacttggaaaaggatcattcaaatatgcctgggtacttgacaagctaaaggcagaacgagagcgtggtatcacaattgatattgctctatggaaatttgaaaccccaaaatactacgtcactgtcattgatgcccccggccatcgtgattttatcaaaaacatgattactggtacttcgcaggctgattgtgctattttaatcatcgctgctggtaacggtgaatttgaagctggtatttctaaggatggccagacacgagaacatgcactcctcgcattcacacttggtgttaagcagctcattgttgcgatcaacaaaatggacaccgctaaatgggctgaagatcgtttcaaagaaattatcaaggaaactacaaattttattaagaaagttggatataacccaaaatcggttgcttttgtaccaatttctggcttcaacggtgacaatatgattgaaccttcatcaaactgcccatggtacaaaggttggtcaaaggaaacaaaagctggcagtagtactggaaagacacttctcgaagccattgactctatcgacccaccatcccgaccaactgacaaacctcttcgacttcccctccaggatgtttacaagattggtggtattggtacggttcctgttggtcgtattgagactggtatcattaaggctggtatgattgtgacattcgctcctgctggagtaacaactgaagtcaagtctgtcgaaatgcaccacgagcaacttactgagggtgtgcctggagacaacgttggcttcaatgtaaagaacgtttcggtgaaagaaatccgtcgtggtaatgtttgtggtgattctaagaatgacccccctaagggtgccgagcattttaccgcacaagttatcgtgttaaaccacccaggtcaaattggagctggttacgcacctgtacttgattgtcatacggctcacattgcttgcaaatttgcagaacttcttgaaaaaattgatcgtcgtactggaaagtctattgaggcaactccaaaatttgttaaatctggtgacgcagcaattgttaaaatgattccatctaaacctatgtgtgttgagtcattttcaagttatcctccattaggtcgcttcgctgttcgtgatatgagacagactgttgctgttggtgttattaagagtgttgagaaacaagaaaaggcaggaaaggtcactaaagcagctgtaaaggctgccaaaaaataagaactgcattgcttattaaaatcactgagaatctattataccatttaccatgcaacgggacttcagatgtcggctgatcgggggagatggaagatttaagggtccatgatggtcagagctttgcgccatttcgaatagtcatgcaagctgatttttcatgttcattggttccaagccattaaaaagcggaatagatagtaaaatactagagttgttaatattggaccatgtcaaaagagcccctgaccggtgatgtaatgcactaagcttttaaatttatcactctccatgaacttccaaatcttgcaaagaaacatccaattagaacccaaattagcttgattatatctacgtctctcaatacttgataactttcagcaacagaagactcaactctataatctcgtggaatctcagatgtattctaaatttgcatgtcattgttttatatgataatgcatttttagcttccattctttacgaggaatttcaattttttc

SEQ ID NO: 627 - DNA, 1515 bp, Artificial Sequence
  Synthetic
cacgattaccataacaaatccaagagttatctgatatacagaaagaatggagaaggggtgtcagtagaagtggttgtgggtggtagtaccttcaggtcacagaaaggactccttcccctccttccacatatcttctttaacgcccccctctttcgctctaatcagaagattatatagtctcataattttttccttctgtatcttttagtcaaactccaattattgctcttcttttggtttcaacctaatttcattcgctcctaaaaaaatgtatttctcaatacttcttttgacaatttcttcactagcttctgcaagcgctgtctctcttggcttcaactatggagctaccaaaagtgacggttatgcaattcgaatgcaatctgactttcagaccctctttcacgctgccaacaacctccctggtacatcaggattttcaagtgcgcgtctctatacaactgtgcaaggtggaactgtaaacgatcccacttcagcgatcccagcggcaattgctgaaaacacgtctcttttattaggcttttgggcctccgctggacaagatgttttcagcaatgaaattaaggcgctaaaggctgccatttctaagtatggcacttcttttacaaatctagttgtaggtttgtctgttggaagcgaggatctataccgtatctccccaattggcgttgctgcaaagtccggctatggtgctgagccatccactattactgaatacatcaaacaagttcgatctgcagttgctggtactcccttaaactccatgccaatcggtcatgttgatacatggacagcttgggttaatgggtctaatcaagctgttattgatgcttcggattggatcggtatggacgcatatccatattttcaagacactcaagttaatagcatagaaaatggtgctagcctttttaacaaagccttggtagatacgaaaaatgcagtcggggctaagcctgtatggatcacagaaacgggctggccagtgagcgggaaaaaatcaggctatgcagaaacaggagccacaaatgctaagacttattggaaccaagtaggatgtcctattttcggggccgtcaacacttggtggtttactctcgatgatacagataacagctaccctaatcccagttttggtattgtctctggcacaaaacccctatttgatcttagttgctctaaatctggatctggaactatctccagcgttaatactgcttcaataccagaaccaacgggagcagttgtatctagtggatccgatctcactccctccgtcgcaaatgggattcaaaatataagtggtttaggtgctgctcccaatgcacttgtaggaagcaacagtacatggagccctagcggtacagtatccagctctccaagagttacgtctgacatttctctgtcgccgacacaaaactcagctccaactttatccagctcaacgattggcttagtgattgctctttttattgctgtaactttttaattaac

SEQ ID NO: 628 - DNA, 1393 bp, Artificial Sequence
  Synthetic
tgataactagtatatgatgtatataagcaccgtcacgtctactattactatgtctgagaccaaaggcagccctcattaaataaaaaaaaataaaaatataactgcacgtaaatttaagctgaaggaacaaaggattaatgaaaattatcctcttggtttccacaaagaatcaacgccaatgaatgccaagcgctctatttgacagtgctatcttcttcgctttgcatcctcacatttctccaaaattctttaaatacagcttaagaaccctctcaaacaccactaccgtcgaatgcacttgcctctaagtcgtgccgttctttttttcaaccagtaaccataatggcagaactcactcaccccaccatcaaggatggatggtttcgggaaatatccgatatgtggcctggccaagccatgacattgaaagttaaaaacattctccatcacgaaaaaagcgagtatcaagatgtactcatttttgaatcaactgattatggtactgtgctggtactggacaacgttatacagtgcacggagcgagatgagtttgcgtaccaggagatgataacccatttggctatgaactcacatccttgtcccaagaaagtattggtcataggaggtggtgatggaggtgtcctacgagaagttataaagcatgattctgtcgaagaagctatcctgtgtgatatcgatgaggcggtaattcggctttcgaaaaaatatctccccggaatggctatcagttaccaacatccgaaagtcaaagttcacataggagatggctttaagtttttgaatgactaccaaaacgaattcgacgttatcattactgactcttcggatccagatggacctgcggaaaatctattccagaagccttactttgagctcctgtttaatgccctcaaagaaggtggtgttataacaacacaagctgagaaccagtggcttcatctcccactaataactaaactcaaaaaagattgtcgggaagtctttcctaacgtagaatatgcatatacgacaataccaacatatccttctggccaaatcgggtttctagtttgcagcaaagatcccgaacaagacctcaaggtacccctaagatcttttagtgctgaagaagaagagaagctgcttcgctactataacgctgatattcacaaagcaagtttcattttaccaacatttgctcgcactgcactgaagtaaggaaaacgggaattcctaagtaaagttacaacataattatcttccaaaatctttaggatatgaaaatctcaagatgaaaatgttatttactactttgataatattggcagatgataaaacgttattggacttgaaggattttttaacaagttttgcactgcaccttattcctccg

SEQ ID NO: 629 - DNA, 353 bp, Artificial Sequence
  Synthetic
cctgggtgagtttttcgtaacgtcgctactttattaacttgatctgccgtggattttggttgtcttgtatcaatcaaaaggagaggaagcttcggaaacttcattaaagatcttatgattggctcctttgaatagtcgggcctctgaaatataacagcttttccttgggaggcaacagtgttatctactcctgaagggtttccatggatacatatttctcctacataagcccacatattaatgcggcttatttgggtatgtgcttcttcaatgggttggtcctcatgaggcccagaaagcgctcttacctgtaataagagcgcagcagctagacacacagtaatagatgcact

SEQ ID NO: 630 - DNA, 1880 bp, Artificial Sequence
  Synthetic
ctttgtgaagcctagataatcttttcttgtaaccaatgcttttgatacaaccatcaattagttgtttcaattaatttataagaggcgtttacaagatcttgttgattttgaatgtctatgtagttaattttgtttctaaggtgccctgtaagggtaggtatgacgcgatctctattttaatctcttgaaacttgggagaatcaatgtgttgagcacttcagtcatatcatgcttgctttggagccagtcacacgcatgataaaaattttgtaaatttttatagttcggccaagatttttctctttgacactaaaagaaatttgtatgtcaaaacccagaaagatcgtgggcgtttggagtaagatccagatcttgaagtgcgttgcatggcaaatctcatgtaatggtgaattgaaaacgatttgccagcaaaattattttagattttcatttatttttagtcggtaataagtcgggttcaataggactaaatcgagtttgcataggaagtagctccaggcggtcattggaaggcccggtactttgtccattctcaatatcactcagctctccatccaaatgtaaagataatccgatttcttcttccccatcatttgcagatcccacataatttcctatcccgactcctgtccagaaacttcggtatgagctacgaggcccccaagcccaacctgcaccatgaccgatcggtagttggtagaagcgaaaagaaacaattgaagtgagaacaccaatcatgtagccaaaaagaatatcaaatccgtggtggcggaaatcggagtaacgagtcgaagctatatatatagatgcgctaaaaggaattgctgcaaatatgagaaggtatagtggaggcgcagctgcttgacgtcttgccgctaaccaaaaatcttgacggtcacacgaggtgaaatttttttggtcattaatactagccgcttcctgcttacttacgaagggatttgaccgaatagagggttttggattttggggtttgttgtatccagtgagagtagattgggataagtagggtatagagatagctagtttagatgccagataaagtgaaagatatatgagccctccggacgcaaatgatgaatggccgctaggataagatcggaagccatcatttagtagaaatcggttggtttgttggcagatatcagcggagacaacattcgttacaagataacctccaactttatatctctctaaattggccatatcaggtatacatctagctaagagatctggtcgtggtttgccgaaaagattcttcattcctcccgttataagaacggtgagtgatagtgaaaagcttaatccaagcaatccaacgtgtaattcccacattctccgatgccatatggcagatctaggcgttgactttgtaaccgtcggtccaggaacaagaactaagcaaatagcaaaaataactaatgccggaattataaaagcatataatccaagccatcgtaccgagactttttcatgtgttttatagggaaagctgatatctgggttctccagcgagaagggtcttttgtttggtaccctcgatccaacaaataatccaaaaaatgcaccaaatataactaccagccaatcgacaacatatgaaagtactagttttaatgacgcgccactacgcccgcggacagctgaggggtttttcattaatctctatgatcatatatagttatttaaactatgatgaagtattgggatatgttccattgattcatgcagtaatattgttatgtataatcggttgagaggagtagccttgtttcatactagtcgtgcacgaaactacttgctattgtggttcgcaaataagggttaagcttatattccac

SEQ ID NO: 631 - DNA, 1656 bp, Artificial Sequence
  Synthetic
caaccacgaacatcaacctgtgctcgcctgctctttagcgtctgtaccttacgcttttaaatcttcactgccataaatctttttctttggaccttttttaccacgcgcccttacacaaagcaatagcctaacatggaagaagaagttgcagccctcgtgatcgataatggatcgggaatgtgtaaagccggttttgccggtgatgatgcaccaagggctgttttcccatctattgttggccgacctcgtcaccatggtatcatgattggcatgggccagaaagattcatatgttggtgatgaagcacaatccaagcgtggtatacttactttacggtatcctattgaacatggtgttgttaccaactgggatgatatggagaagatctggcatcacactttctataatgagttacgtgttgcaccagaggagcacccagttctcttaacagaagctcctatcaatcccaaatcaaatagagaaaagatgactcaaatcgtctttgagactttcaacgccccagctttctacgtctctatccaagctgtgctctccctgtatgcctctggacgtacaacaggtatagttctagactctggagacggagttacccacgttgttcctatctacgaaggattctctcttcctcatgcaattgctcgtgttgacatggctggccgtgatttgactgattaccttatgaagatattagcagagcgtggctatacattctctaccaccgctgagcgagaaatcgttcgtgatatcaaagagaagttgtgttacgtggctttggattttgaacaggaaattcagacagcgagccagtcatctagcttggaaaaatcttacgaattaccagatggacaggttataactattggaaacgaacgattccgtgcgccagaagcactttttcaaccatctgtgcttggtctcgaaagcggtggcattcatgttactactttcaactcaattatgaagtgtgatgtagatgttcgtaaagatttgtatggaaatattgttatgtctggtggaacaactatgtatcctggaatttcagaccgtatgcagaaagaaataactgcacttgcaccatcgtccatgaaggtcaaaattattgctccgcctgagcgaaagtactcagtctggattggtggatctatccttgcatctctctcaacctttcagcaaatgtggatttctaagcaagagtatgatgaggcaggaccatctattgtacaccgaaaatgcttctgattggtactatggccagggtcaattcaattcaatttttttctatcaaataaaattaaatcaaaatagttttcaatccaatctaacccaatcttaatcttaaaatgtaacttcaaacattgtgattcaagtactaatcacacgagaaactagcaacgtttgatctcgcttttcgatctactttaggtacttgatgaaattttcaaagatattttgtcataaaaccagtcactaagcttctttgctatataattgcactacgcgacgtcaacagatgctcttttcacactcctagttattaaagcaattgaaacatcttctaactatatacaacttgaatataactccagatttgaatatattctccaccaaaatttaattaggtttgcaataaattca

SEQ ID NO: 632 - DNA, 1014 bp, Artificial Sequence
  Synthetic
tgtgaacatcacctgggccaatattgagaacatgaccgaggctactctaatcttagatatgtttctcaacaacgagggagcctttaactatcctcacatttcctttcgcaaaaatttccaccctttcaacttctctaaaaacaattgatttgcttagaccataagaatatttcaatatgattaaaactgaagctaatggtgaaggatttgatatttctattccagaggtatcagtaactgaggaacgaaagccatttgtgcaaaaggaaggatatctcaaattaaagcaagcaggaactgcaagagcgaatgaagccgcttcatacgaagctccacgtggcactgtaaaaggagattacgcataccgtcatcgacatcagacagtactccaacagcatatagccttttttgatcatgataatgacggtactatatggccattagacacctttcatggttttcgtgatattggctacagtctagcgttcagcatattctcaatgtttatcattcatgcgaatttctcttatccaactgtctctggtattcttcctgaccctttctttcgtatttttgtggctagaatccacaaagataagcacggaagtgattcaggctcatttgaccctgagggtagatttcaaccgcagcaattcgaagatatatttgccaagtatgctagtggtgataagcagggcatcacattcatagagatatgcaaatatattaatggtcggagagtagtgtttgatttttttggtttttttgcagcagtatttgaatggctagctacttacatcttgctttggcctgcggatgggagaatgaagaaagaggatatccgaggcgtatatgacggtagtttattttacgaaatttctgcccggagacacaagtctaagtcatcttaagcagctctgattcatgtgatcattagttcttgtagaactatgcatgggattatctagtttcttcttatctagtcaataatatgagacaattaaatactccgaa

SEQ ID NO: 633 - DNA, 3945 bp, Artificial Sequence
  Synthetic
ttgacgccaaattagttgcatctcaactcgtacatctgtaattaccagctgctgcaaacgtagatggcatcgatttctacagtatagatatttattttgttcaagcatcactacttatcttcaaattaagctagatacaaggctgtaaccgccgttgatggctcgagataacccttagcgccttcgggacagaaacaaaaatgttggcttcattaccaagactattattcccgacacggccgtccacctctagctcaaaaaggattgaaggtcctggatttatcaacaaagtaatcactttattagccagcaagctttctcgccgagcttgtgtgcatcccatacatacagtagtaattgttgcgctattggcgagtactacttacattggcttattagaaagtagcctttttggcaatgtcaaatcgagttcagtggcaaagatagattggaattctttgcaagaagaaagtagacggctacaagcaggtcctcaaacagagtggaaatggatttctttagagcccaaggtccctgtaccatcaggcgcagatcatttagcactattaacactgaaatttcctgattatctaactaagaattccaatggcgtactgtcggatacaattaactttccgcaaaatctatcaatcaaaatcctcccgtcaacttcaagtcctttggataccgtaagtaaagagaccagtttggtgatctctgtgccaactagtcaggtatcagagttcatgaattttgttcaaatattaccaaattcatacacagaaaacaaactagatgatatggaaactgcaactattgaagaacaaaaaagatggataatcaaagctgcaaattctgaaactactagcagattcttcaaaaattggctcaaaaattcctgggccgctttcttagatcaactcagaaatgcagaggctccagatatcataattgtcttactaggttacatatccatgcacttaacattcttctctttaatggtttcgatgaggaagatgggatcaaatttttggctatttggaatgactctcctatcttccacatttgccttcctcttcggccttattgtcactaccaagatgggcatagccttagatatgattattttatccgaaggccttcctttccttgtggttaccataggttttgacaaatctattattttgacaaaagctgtgttatcagctgccctacggaatagaaggccagctccaggattgttaggaaataatagacagccagcttttgagtcaaaacatgttgtatcatcaactacaattccgtatgctgtccaattagccatcgaagagaaaggatacatgatagttcgagattatgctatcgaaatatgtatccttataattggtgctatatctggcgtacaaggtggccttcaacaattttgctttctagctgcttggattttagtatttgactgcatcttattattcacattctacactgctattctcagtatcaagttagagataaatcgtattaaaagacatgtagcacttcgtcaagctctagaagatgatggtatcaacaaaattgtcgctgaaaatgtcgctgaaagtgaagagtggcccaaaccaagtttggtaggtaatgatatgactaacatcttcggaagaaatataaataataatagcgtgccaactttcaagattctaatggtcagtggatttattgttataaatgtttttaacatttgtacgatcccctttctaggaggcagcattgatcatgaattatccagctcaatagggcccatgagaaattctataattagtggaaacttatcgccatcaattgatccttttgcatttacctcaagcggtctcaattcgatgcttgaatctagcaagagtcaaggtagaacagttgtggttgatatttttgcgcccatcaactatgaacttgagaattcttctgaaacttttggatcacaatcgcgtaacgttgattatcctgtgaatttgaacggaaaatatgtcaatttgaatgaatatggaattagtggtcgcgtcattactagttttttaagtagcttagaagaccctactctatcgaaatggataatgttagctcttgctttaagtatcgcaataaatgcctacctcttcaatgctgctagatggagtatccgacaccctcttcatgtttcttcagaccaaaattttgatccaagtacaattaaatatcatcagaatgaagcttcagatgttatctcttcgtctccgcaaaaaaaatcccaattcatggaaactaaccagccttatgataatacccttcagacaccaattaatatagatgatgaagaagaaggattagaaatttgtttaagcaaatccaaatctccttcaaagaggacccaagcccagctggaaatgatgttgaaagaaaatcaagcatccgaacttgatgaccaagaactgattgaactttcacttcaaggtaaaattccaggttacgctttagaaaagaaattaaaagatactactcgagctgtaaaaattcgaagagcagttatatcacgtactttaacaacttctcaaacaactggtctattagaatactcaaaactaccatataaaaattatgattgggatcgtgttttgggtgcttgctgtgaaaatgtaataggctatatgcctttgcctcttggtgttgccggaccaattataattgacagtcagagctattttattcccatggcaactacagaaggtgttcttgtcgcaagcacaagccgtggtgcaaaagctattaatgctggtggtggggcagtcacagtaattactggcgatggcatgacaagaggaccatgtgtatcatttgagacacttgagagagcaggagcggctaaagtatggcttgactctgagataggtcaaaagattatcactaaagctttcaactctacgagtaggtttgcccgactacagtcaatcaaaacggcactcgcaggaacttatctttatccacgttttaagacaactactggggatgctatgggaatgaatatgatttcaaaaggtgttgagcatgctcttaacgtaatggctactgaagcaggatttgaggatatgcaaataatatcagtttctggtaacttctgtaccgataaaaaaccagctgccatcaactggattgatggtcggggaaagagtgtagttgccgaagctatcattcctaaagatattgtcaagagtgttttgaaatctactgtggatgcgatggtagaattaaacatctcaaaaaaccttgtaggtagtgctatggctggaagtattggtggtttcaatgcccatgcggcaaatatcgtcacagctatatttttggctactggtcaggatcctgcgcagaacgttgaaagcagtaattgcataactctgatgagaaatctcggaggtaaccttcaaatcagtgtatctatgccttcaattgaggttggaactttgggtggtggcacaattcttgagcctcaaggcgctatgctcgacatgttgggtgtgcgaggatcacaccccacacatcctggtgaaaacgctcgtcgtctagctcgaataattgcagcatctgtgctctccggtgagctctccttgtgcagtgctctcgcagcaggccatttagtcaagagccatatggcacataacagaagtgctcctattacaagaagtaatacacctgctcagattagcacacacccatcaatgatatcaacaaatagcatgagagaaaaatattgagatttgaaattctaattgtgtaaatgagctcagctatattgaaaataaattggtaatctaatatagaggtagaactagttcgatttttatactcattaaaaaaaggaactaatattggtaaagggttaagctatgaaattagctatccttttttttcctatttattgaaaaa

SEQ ID NO: 634 - DNA, 1874 bp, Artificial Sequence
  Synthetic
tcgatttagaaatgaacttgtcctcttttgattccaaaccatcaaaacgccatcgagaacagccaaacccctgcatttaaccccttccttaccccttctcatcactattgaataagcattccacctgtttccatcacagcgcaaagactcgagtctagtgggtgaggaaagcgcacacgaaggtctggtaatttcggactgcgattatcaaaattttcaccaaaagagtgtattaccggtgttacttctttccgaaaaatacgccaaaattgtccaaatccacatcaattcaagccacccgcaccgatacccaaaagccaaaattgtctgagcatctcggttcttacatttacgccaatcttaattcagctgtcccccactaggttcttgcgacaggacaaatttcatttgcaccccgcagatagatagggtgcaagcacctatctcaaaagagccatcgtcgtcatacgcattacagcctaggacaatggccgatgtgaccgatcagaacgatcaaggttcacctttaaaacttgaggatattgaaggaaatagcatcccaattccaggagacgagaatcatggaattaaacgccagcgacccccaactgttgaaaatacacaagaagaggaggaggaggaagataagccagggcgtgagcgccgaaagattgaaattaaatttatcgcggataagtcgcgtcgccacatcacgttctccaagcgtaaggcggggataatgaaaaaggcatatgaattgtcaattttgacaggcactcaagttctcctccttgtagtctccgaaacaggtcttgtgtacacttttactactccaaaactccagcctatagtgacaaggaatgaaggaaagaatctcattcaggcatgtcttaatgcgccagaaccaattggcgaaaatggactagatgatcccaatgccgataatgcgccagatgactcaccttcacagcagcatcaacagaaccggtctggaatgccgcagcagagtactaacttacatagttataatataccaacgtctctggagcaacagcaacaacaacaacaagcaattgcatatcaaaactacctttcacagcaacaaagaagcggatatcctatacctcaaactgctatcccgcagcaacatacacatcaagcgtaaatttaccagtatataaatgaaaacatttatctgataaaaatttcatcgataaccgacaccattcagttcctactctccgcgtggctcccaagtctcgtaacttcatttaaataagtgtctggattgttgaatgggattctttttagtcgatcaatttcaattaactcataacgcagaaatttcttaaaattgaacgatttataggaaccgatgtgaaattttcttcaatctccatgtcaatcgcagatgtgggcaaaaaagattgggaagagaattcttagttatatttcatttgaatactattggggtaatgcatgtccaaagagtctcgtaccaagagatacctttatctggaaataattagaagatttacccgtcttaccttgatgaattgtgtgttagagatacaccatggctaagatattaatatctatttagtttgggaagttgatgacgatacatcacagttctctgtaaattttgttatttcctctaatatcattaatcttagctgaatcgccaaatctcagcggtttgagtcactacccacagctttacttttccgaaaagcatgaaatcttgctttagttgaattatttgcaacgacggtttttgtttcaaggtcgacttaaagtactcgatgaaaaggaattatcataagattatcattacgagggaaaatcgtaattttgaaggctaggacaaacag

SEQ ID NO: 635 - DNA, 1254 bp, Artificial Sequence; identical to SEQ ID NO: 499
  Synthetic

SEQ ID NO: 636 - DNA, 628 bp, Artificial Sequence
  Synthetic
gaaataactcaccgaaccggcttcgtcgtcagtcaagtccggttatgccgagtcgagataatcaatcttatatctccaattctgctcctcaatcattagctatagagaagaccaagctagagcgagtacaaaaacatcccgcaacatatcaatgtcatctttgccccaaaaaatttactcgcgcctataatcttcgctcccatctccgaacgcatacaaacgagcgaccttttatctgttccaagtgcacaaaagcttttgcgcgtcagcatgatcgaaaacgacatgagagcctacattcaggtgaaaaaagatttatttgtagaggagaacttaaaaatggtggtcattggggctgtggccgtccctttgctcgtgcagatgccttaaatcgacatttccgatcggaagcaggccgagcttgcataaatccactcatagaggaagacgaatctgaaaatctacggctatggaatgagaaacaaattcaaaatattaaacaaactcagtcacacgtagcaatttcaagtgaaatggatgtggctctcaatcgttttactttgcctgctgctcttttagcacagtatcctgcactcacgccctatagttggacagatttacctcaagg

SEQ ID NO: 637 - DNA, 2153 bp, Artificial Sequence
  Synthetic
caactatatgcccgaacagagtatcattgcatgtacccttcagctcaaaatgtttcattagatttacgaaacgccaacgtcccaagcaggttggggcagactttttattatcgccaatgctgacaaagcgatagcgtaagatacgtgtgttctccttaatttctacagatcccatcattaacgcttaattcgcaaatcgagaattgaagtttgatcaacttaataaaacttttaaatccctgcgaggatttgatctagcagcctgtttagtgtgggcaaagggttcaataaaagtacttgggttaaatcaaaatcatggctagtaccgatgacatggagaaaaacgcccaaggcagtatagcacgagcacaagttgataatgcattaagggcgatacatcacaagaaaccaattccggagattgactttacacttcacactatggaagatggtagtcaagtgagcactttagagagagtctgtaaagatgtacaggcaccggcaatgtttccaccaacagatgaacaattcttctcaaatgaggatcccaaaaaaccaaatttacctttcttaaaacaacatctctacagagaaggtcgtctcactgaggaacaagcactgtacatcatagaagaagggacaaaaattcttaagcaggagcctaatttattagaaatggatgcaccaattactgtatgtggagatgttcatggccagtattacgacttaatgaagctgtttgaggtgggtggagacccagctgagactagatatttgttcctaggagactacgttgacagggggtatttcagtgtggattgtgtattatacttgtggtctttaaaaatatggtttcctaatacattatggcttctacgcggaaatcatgaatgtcgacatctcacagattacttcacttttaagcttgaatgcaagcacaaatactccgaaaaaatatatgaagcatgtatggagtctttctgcgctcttcctttagctgctgtcatgaacaaacagtttctttgtattcatggggggttaagcccagagctacatacattggaggatttcaaacagatcgaccgatttcgagaaccccctactcacggactaatgtgcgatttattatgggcagatccattggaagagtttggacaagaaaaaacttctgaatattttatccataatcatgttcgaggctgctcttacttcttctcatacccagctgcttgtaattttttggaaaagaataatctactttctataatccgagcccacgaagcacaagatgcaggatatagaatgtatcgcaagacacgcactacgggtttccctagtgttatgactatcttctccgcacctaattatctcgacgtttacaataataaagcggctgtacttaaatacgaaaacaatgtaatgaatattcgccagtttaattgtacacctcatccatattggctaccaaattttatggatgtcttcacttggtctctgccctttgttggtgaaaaaatcacagatatgcttattgccattttaagcacttgttccgaagatgaattaaaagaagacttaaccccaaccgctatttcaccttacaatcccatattatcaccaacttcacctattgatcctgattctattgaatataaacggcgcgccattaaaaataagattctagccatcggtcgtctttcacgtgttttccaagttcttcgtgaggaatcagaaaaagtcactgagtttaagactgcatctgggggacgtttacccgcaggtactcttatgcttggagctgaaggtattaaagatgccataactggcttcgaagatgctcgtaaagtagatttaaagaatgaaagattgcctccaagtcttgaggaaattacacgaacaagtgaagaggatagagctctggcattagagagggctaaggaaagtgcggataatgatcgagggcttcagattttatctagaagactcagtttagttggcactcaaccaaatagaccgcaaccgagtaaaattctgaactctgttctagccctcgataaagatgtttctgagaaataagaggtcgatcagagtcacctcctgttacaagctcattggttggtctgcaggtacagaattactaatcataccacgag

SEQ ID NO: 638 - DNA, 1989 bp, Artificial Sequence
  Synthetic
attttctgataagttatgatgccaaaattttgcgttttattccattgaaagcaaaataagtatccaacgtggctttactcattgatggcacacaagaaacgaacgatttgcatctggttataggtgctcaggatggcgacacattgttttgactttctgtaactatttgctctgtggaatccacgtgactgactcttagcgaatgcaacgtgtgatacggagttctgagccagcatctcacctcaccgtcaatagccatcgctctaccaacagcttgaattgcacggaattatcactatcatcccgactaagcctctcaaaaagcaaaatttatttgctagctcggaaaagataacagctagctacgcaaaagctattcaagatggttgttggcattcattttcgccaaactctcagaaaagctgcaacaaatccccgtcatatagaaaacaactctaatcagccagaaactatgttgtccggagaaaatattgggttacttacggggcgaacatcaaacgcccgcaaaagtgcgtggcgacaaatttacgatgtactcggaagcaaacattattcagccggaaaagatagtgatagtaaaattgtacgagctatagcgccaactattcagattacaaaaattacgttatacagtaattatgtcaattttctcttgatatttgtgcctctcggcataataggagggtatctgagctggaacccatctatagtgttttttcttaattttttagccgttatgccccttgccgccgttctatctttcgctactgaagaaatatctatgaaggttggagaaacgctaggaggccttttaaatgcaacatttggtaatgctgtcgaaatgattatcagtattgttgccttaaaaaacggcgaacttcggattgttcaatccagtatgcttggaagtattttgtctaacatgcttcttgtcctgggttgttgtttcttggcaggaggcattcataatagaagaaccggcactgcagcaggaatcgaacaaagtttcaattcaactgtggcctcaactatgtcctctttaatgactgttgcagcggctactttaattataccagccacgctttatgcggctctatcgacatcttctgaaaatacgaataatggtatccaatttctctcacatggaaccgctattatattgcttactctttacattctatatcttacgtttcaattatcaacacactcttccctttttgatgctgaatcacaggaacaagcacataactttgaggctgaatcggacgatacgcatatgggggcatggcctgccgctgctgttctcattattgttactgtagccgttgctatttgtgctgaatacctcgtagactctattgactctattgttgctaccgctcatatttctaaaaccttcattgggctgatacttctcccaattgtcggcaacgcggcagaacatgcgacggctatagtggtggctgtgaaagataagatggaccttgcaatgggtgtagccattggaagctcattgcagatcgcgctccttgttaccccatcattggtattattgggttggattattggtcaaccacttactcttcgttttgaaacatttgagacgatggtattcttcttgagcgtgctggtcgttacttacgttattcaagatggaaaaagtaactatttagagggagctatgctgcttgggttatacttaattatagcactagccttcttggtatatccagatgatgcagggactactcttcctatgactagttcaatctctaagattgctaacaaccttcttggccgctgatgatctcagttgtcgttttttttgccgcattaggtaagcgggtttttaatgaagctaatgagtgtaagggtgtcagaagtttgcgatgattaaacattttttacgatttcaatatatttatactaacgcgttgtgtatggaaattaaaagttaatctaattggc

SEQ ID NO: 639 - DNA, 753 bp, Artificial Sequence
  Synthetic
tcgcattgcaaacacagtgcattagggccccagaatgcgtaagaggaaaagccatgcaaaatctgaatcatcaatccaacctggagatccacttcctcgtgaaaaaaagcgccgttacaggcctggtaccttagccctcaaagaaattcgaaaatatcaacgttccaccgacatgcttctcttaaaactcccgtttgctagattggtccgtgaagtcgcgttacaagtgcgacctgcagaagaaggttggcgatggcaatcccaagcaatacaagcgcttcaagagtctgctgaagctttcctggtacatcttttcgaagatacaaatttatgcgctattcatgctaaacgtgttactataatgcaaaaagacattcagcttgcaaggcgaatcagaggggtttggggtggtttaggctagcttttttattctaaatataccagtgcccgaatttgatctccctaagccacaccatcgagttgaaatgatgagaggaagatgacgagaataaaattattgtgaatattcgttatatggataagcgtagaggggatctaatacttgtgaattggtaatcttgagttatcactttttctggcgcatccagcgaccctaagcatatggacactagtgattgcgtcttagggttatagtagccaagaggaatttgaagcacacatattagcacagcataataataaataaattgaatgggcctgccaagaaaattggagaccttcctctatccccaa

SEQ ID NO: 640 - DNA, 918 bp, Artificial Sequence
  Synthetic
taattaaggagtttttaaagtgttgaaaaacttctaagcatatttaatcttgaacttaaatttaagcaacagtttttcttaatttctattcggggaatatgatgtcagaaatctagtattttgtagaattacttttgctaattatcttaacattctttactttagctcaccacagtcagtgataactggcttatttgtataggaaatattgccgttactgcttccagtagcctcaagtgcttttacaaccctcatggactcttcatcagctacctcaccaaagacaacgtgtttaccatcgagccaactagtaacgacggtggtaataaagaactgagagccgtttgtgttgacgccggaattggccatggaaagaagtcctggcttattgtgtttgagcttgaaattctcatccttaaatttttctccataaatggattttcctccggtgccatttcccctggtgaaatcacctccttgcaacatgaattgaggaataatacgatggaaagcagagcccttgtatccaaaccccttttcaccagtacagagagcacggaaattttcaacagtaagcggaacatcttgctgaaatagattgaatttgatagtcccagattgtttttcaatcttagcagttggtcgaccagcctggtcgagaactggtccctcccaattaactttgaagaacgttttgaccgacatatttgttgttgaacagtggaaatttctgacaggaaatgaaaatttaattttggatggtaacatgaatgagaactggcggggtatcattttgaagttgagaatacgctagctcggaataggcaagcgagatgactgcggtgggttgtgctaacgtgacgcaggtattcggcgttctacctcaataagcacacacacaaccttcacttgtgttaa

SEQ ID NO: 641 - DNA, 2177 bp, Artificial Sequence
  Synthetic
ctgttaaggactctaaagattgtgatcgagagctaggtatagacattccaattttcttaccgattgctaatgcagttgcttcagcatctcccgtgatcataattaccttaacaccgctgcgctcaagacgcctgatagcctttctaacaccagatctgggaggatcactcataccaaccattccggcgaagacaagacctttatatacatcctcacgatgagagacgttatttgttagaggtataactttaggtgttggaacaatttgactatttttatgatttactggtttcgtgtatctagtcacgggcccgcttgcaaaaccgatcacccgaagaccttcttttgcgagattttctgccatatccagtgcctcttgtcgatgttttgtgtctagtactatttcttgaccatccttattcacataagtatcacacctactcaaaactcgatcaatagcgcctttgacgtaagctatctctttgtcacttgaagcccaatcagaagttaaatctcctaccgtgacgcccatccattttctttctgagctaaatggcatttctccaaccctatgttcaattccttctctagcatcatgttctctaaacctatcaagaagatcaagcatagctacatctgtaggctgcccaacccagcgactgcgaagaaaattttctccccttgattgtctagcagtcgaagagagtattgccgcagagctcgcagaaggtggagagctgtattgccaagttaggcgtgcattgttagcaatgtttccaatccggagtattcgaagagttattggatcaggagttgcttctatagcttcatctcccgagtctaccttgagcggctcgtcaatgccaaaataccaaagtttcgtagttgacatgtgattcatcgtaagcgtacctgtcttgtcgctacaaacaacattaacagagcctaatgtttctacacttggcattttccttacaattgcgttctgctttgccattctatgaactccaagtgctaaagttacagttacaattataggtaagccttctggaatagcagcaactgctaaagatatagaaacagtaaacacttctaaaaggccttttccttgaaaccatccaatcatagaaataatagcaattatcaaaaaagatgcttggcttaaatgtgatccaagggagtccatggaaagctgaaggggtgttctagggctttctgtctttgttacagctgcagctattgaaccaaagtgagtattttcaccagtcgcatacacaataccttgcccatagccagaccgcactaatgttcccataaaagcaatatttgttaaattacttgaatgcgtttctgcgcctaaaccaattccattttctccatcggattggaacctctgtgactctaatgcacccagatgtgaaattgtggttggtccacagtagtctttagcttcggaagtaatattcataggctcattttcgcctgtcagatttgattcatcaattgtgagatcaactgcctttgtgacacgaatatcagctggaattcgatctccagtcgaaaaaagaactaaatcaccaggtacgagctgtgaagccattactttactagatttaatttcgatgttggtcaaatcaattgtaccgatactgaaatctttggaaacttcacccgtgtgttccttcgatgatgtaggtggccatactgaagtgttttgtgagtttgttgttcctatttgatctcctcgaatgagatgtgcatgattaggtactagatgattaagcgcctcgatagatttttctgatcgatattcctgtataaatcctactgagatgacaatagtaactgcaactgctatactgatagcatcgtctttgttaccaaccacaagagatgcacctgcagagcaaagaagtagtagaataagaggctctttgaattgcttcaggaatcttagccatattggctcgggtgcttcatttggtaactcgttagctccatagtagtgaaaacgagagagggcttcagctgccgtcaagcctgatacaagagaagtttttagttgttctgccgtcgcggaaggcgtgagaagcgcatatcgctctgctgtcgtcttcgcaattgtggacagtgaacgcgtatgtgtaattcttcttcctgagctagttatttcactg

SEQ ID NO: 642 - DNA, 896 bp, Artificial Sequence
  Synthetic
cacatgacgaaaatctataacattttatgaaaatcttttaacttatttaatgctgttggttcttacaagatatagaccaatactgagaagggagcgttatatatatatttatatatataaaggtagcttggatttcactgtaaccagaaaaatagctaaatctttgtctgagaagtccataataagtcgcaaaggattgctgtcatcataattatagagtacagatttcgaaaataaattactcgttatctgagcgtctgacgctcaagttgggatctttatgccgagcatttgaaagatcttgaactttatctttgcatcataagttggacaaactcattataatcaattcttccatcaccatcttgatcggcttctcttatcatttcatcgacttcatcatcagtgagcttctcaccgatagaagtcattacatagcggagttcagcagcagagataaagccattattatcacgatcaaagaccttgaatgcctctcgtatttcttcctctgaatctgtgtctttcatttttcgagccatcatagtgagaaattctggaaaatcaatggtaccattattgtcagcgtcaacctcatttatcatatcctgaagttctgactcggatggattctgtccaagggatcgcataacagtccctagttcttttgtagttatttgtccatctccatctttatcaaataaagaaaaggcttctttgaactcagatacctgctcttctgtaagagaatcagccataattgcaagaaattgaacaagataagaatttaagcgtgatctttaatttttgatttcttattcagaaaatattcgatatgtagattcgaaaatggttacgaattaggatatccaaggagtttgacattactggtgcgg

SEQ ID NO: 643 - DNA, 377 bp, Artificial Sequence
  Synthetic
tcatgggtgggaaaataggctagaggatgctcctaacaagcaagtggtggctgaagatcttgcaaaagcattgaaaaatatacgcgacggaaataaaagctgcttcccagatagtcccattagtgatcgtggggaaactggatatcgaactcgaagtacaagttgtacaactatttataggcccgaggaacatggtggtagcccaaacttacctgcgataaatgtagaggatacaacaggtgataattgtgaaccaattcccatggagcacgaaaagcctatctatgcacatacgagtagacctccactagagttgatggatgtttgcctttgttgattttttttgctatggatttttattattctgctagaaatat

SEQ ID NO: 644 - DNA, 383 bp, Artificial Sequence
  Synthetic
tgaatggtggctgccacgtcaaatatatgctcgattgaatgaaatggttttgacagttctttatttacctctactcctagttgcggcttggtttgaaacatgcagtgcgaacaaagttacagctaatcggagccgaggtgaagatgatgatgatactctccaagaatgggaacagttaatggctgaaaacgattttaatactgatggctgggataaaagagttcaatgtgtgaagacaaatattgaagaggatcaaactaatgtagagattttaaaattgatacacgaagttgaagaacttaagagcctactgaaattaaatttagaaaagatagcgtaataactatgataaacaattccatatatttgttaaagcttataaa

SEQ ID NO: 645 - DNA, 398 bp, Artificial Sequence
  Synthetic
gctcttctcaatggatcccaagatgatctaaatagaatcgcagaacactttaagttgacaaagttgaaagagctctatgaaaaacaatgtcaagttttaaaaagatttgatagacccaatccttctgttccaatagccatagcacatttatatcctccaggccctataaatccacattactcagcagctatggcacgagaagctgagaaaaaaaattcaaaccctcttaaaaacactgcaacacaaactagttctaaggaggttggcttaagtaccattagtaataaaaattctcttataaattcgaggcgctcaaaaggacaagatatgccaactcaggctagcagtttggcagaaaaatttagtcaaagtatgatggatcaggagcttgatgatga

SEQ ID NO: 646 - DNA, 398 bp, Artificial Sequence
  Synthetic
gatagcgtattccattaggtactcttaactctgctacattacaaggtatttcagctagtaaaagcaacatttcttgtatcaagttctcgttccacttatgtttttttaatatttcaaaactagcagcaagataccgtcttgttaggagcaaaaatttttccatacgtaaaacatcaatgctggtccactcgcgttgcatggtttgccaaaatccacgtagaaatggaatgacactctcaagtggcagtatgaagattaactgagctaatgaattggctagaccttgctgtgcgagcggtcgatcagacatccacatgcaataaaataggcctttccataatttcagtatttcaataggtgtcaaatctcgtcgacctgaaagatacgttcttaatgat

SEQ ID NO: 647 - DNA, 389 bp, Artificial Sequence
  Synthetic
ttccggcaaatttgttatgcatgaccttcacaaaataggcggaactccatcgctgatcaaacttcttctgaaagaaggaattattgatggctcgggcataacagttacgggaaaaacgcttgccgaaaatgttcagaatgtacctgattttccaagtgatcagacaatcattcgacccttttctaatcctattaaaaaaacagggcatattcagatattacgaggctctctggcacctggtggctctgttggcaaaattactggcaaagaaggcttacgatttgtcggcaaagcaaaatgctttgatgctgaagatgactttattactgcgctcgaggatggaaagattaaaaaaggagaaaaaacggttgttgttatacgatacgaag

SEQ ID NO: 648 - DNA, 394 bp, Artificial Sequence
  Synthetic
tcaggcaagggtggagtgggtaaaagtacatttacaacactgcttgcacatgcacttgcaaaagacccggaaattgtggttggtgtcatggatacagatatttgcgggccaagtattccaaaaatgatgggagttgaggaagagattattcacgtcagtaatacaggatggagtccagtttgggtacttgaaaatctagcagtaatgagcgtgcaatttatgcttcccaaccgagatgatgcagttatttggagaggaccaaagaaaaacggcctgataaagcaatttttaaaagatgtagaatggggcgaaatggaatatttattagtagacactccaccaggaacaagtgatgaacatttgagtgtcaacacttttttgaaagagagtggaa

SEQ ID NO: 649 - DNA, 398 bp, Artificial Sequence
  Synthetic
atcagaggctgttatgtctgatttgaacacatggctatacagaattagagaaacatcacaatttcttggggaggtagcattttatcataccgaattgagaagaagccgccagaaagaaagaataaagacaaatcctctactcggaaaatttaaactaaattctgccattgagcttgtatttgatgagactgaagaatttaacgttttggataatgaagagttgcaggtcgattttactccactgtttgaatgtatgcatattcatgaagctttaggtcaaagtgacaagtttaagtctcaatatgctgctacaagaaaacaacaaaaagagttacttttacccaactcagtgagtttggttgatgacgatgaaaaaagttttagcggactattagaaa

SEQ ID NO: 650 - DNA, 396 bp, Artificial Sequence
  Synthetic
taatctcgaaggtagtcccgaagatctgagctcgcacaaattctgccatgatgagggaaattatcgtatgaaacttctgagagctgagaagtgatggtgaacttgatggaggtggggtcggaaaagcgtgaggaaaagtgctagtgagacgcaagatccgcagagttatttagtcgttttatagtatcattccttgtaaaatgtgggtttattatagtcactctgtctcagaccaaagatccaggaagtctacctactcacagcgtagcattcaaaatgaggagcctcgcataatttcagtcataaatatgaaagaacaaagtacatttgatagctcgggtaactagtcggagcttgagttactgcccgtagcttatgttgagagctaaaaatatg

SEQ ID NO: 651 - DNA, 397 bp, Artificial Sequence
  Synthetic
atcgtcgcttctcttccctcaaaacaaatacaggagaatcaataaccctaattaagttggataagtcaggaggatgtgttgacagggatgaagaatacttgaggcagagtagagaatgctctattaaagaatacttctttggcgtacctaatagtactttaagtcctcatacgctccagattaattttgacgaggtttttatttacaggattaaagagataaattcattatcatttatgcctggaggcgaagaaatttttgaccaagaattatacgaaaaaatagagcctaatctatcgatgatgaattgtattcttgccgtaatgtatgcgtcaggagcagactcacaggaaacaatacgagatgcaagtgttatgggctttgtttatgtttctga

SEQ ID NO: 652 - DNA, 398 bp, Artificial Sequence
  Synthetic
cgcggacagatgagatgggtaatacatttcttggggattgtgattcattgcggagaaaggttcgtgagcgcaaatataatttggtgcgattggagaagtattactatacggtgtttgcgccagagataaaggtaatcctgcactgttgggcagcaccggagacggagttttgggccccgtagaagattgactagttgaataaggtgataaagagctaccgttcagaacaacggaggatgttatcgaaccaagacgtggagagtaagcctgtggcggctggggtaaaggtaaatgaggcaaccgatcattcacatatggcgatttttgaccagcgtaatgattatagagaggtgcgtcagtaggtccacgaacttggacttgggatattgatgggagat

SEQ ID NO: 653 - DNA, 375 bp, Artificial Sequence
  Synthetic
aatagcagtttgagttggggttaataatgagtactgagccacaagtactagacactggagagtcttgagatctttcggcctgataacttcttctaaaaactcaatggcggctagataataactatcagctaacccagcatacgcagagtccaatttctgtagtgaaatagagagtactattcgaacaacaaagttctgataaggatcagaacttccatcataaacatcaagtatatctctttttaaagatggctcatgtagtgtgggtgttaaatactgtgctttttgattgaagacttccagcaattcttccgtaaccgaaagactgggtaatacttgtgctggtaaagcgctaactctaggatatttcttttt

SEQ ID NO: 654 - DNA, 398 bp, Artificial Sequence
  Synthetic
atcagcgttgttattttacccgattattgtctacggcgaacgtaagtcatcattgactgtgccagagttaagagtaatcatgtcgtcttttacaccatacccgcagccgcggttacaaatatatcaagacccagaccaatccgccaccatgttccaaactatgaatcagacaatgtcacaaccagcacaacttggacgcttaagagacgcatcggcgagaatcaatattatgtttaatccccctccacaaactgttaccgccacgaaatctccccaaaagacagcttggaggccttccaaatctcattcacaaacctctctcagcaataaattaaacatggtgctgattccaccacctggatctaataatgtctccaccgactccatctcaaaaaagc

SEQ ID NO: 655 - DNA, 241 bp, Artificial Sequence; identical to SEQ ID NO: 441
  Synthetic

SEQ ID NO: 656 - DNA, 392 bp, Artificial Sequence
  Synthetic
attgtcgtggatttcaagtctttgataaagaaatgactgggtttattggtgtgggacaacttcgatatatcctgacaaatttgggcgaaaaaatgagtgatgaagaggttgatgaattattgaaagcagtcaatacctcgagtggagagattaattacatagatttagtgaagactattctagcaaactgaggaaacgaaaaaggatattattaaagtgttggctctttttggttaatcatgggaataggaattcatttagtaatttacttttatacgtccaatttaggagttaatgtggaaccacgataattttatgtgatgaactaagggttaatcagtgatcagtgagtgggctgcttttgaccgagttcatttcatgaattaatataa

SEQ ID NO: 657 - DNA, 378 bp, Artificial Sequence
  Synthetic
cacgaatacgtgtaattccttctctcatgatactttctcgtttctcacattgctttttgaatttagaaaatgctagcgtttctaaatctttttgttgagcttttaaatcgttgatcatggccatttgctcgtcaatttttactaaaaagtccttgacatgcctatttacattgaatacgtttctggtaaccttggtttgaatattttttgctcgatttgcataacgcaatgtattctgagtctcatcaaaatgtgcactagacggacttacgcaaacaatcattacggtcttgcaattgccaccgagagaaaactttagcagtcgagttaactttgaattccgatatggaacgtggtttttttttcggggatcacaaa

SEQ ID NO: 658 - DNA, 396 bp, Artificial Sequence
  Synthetic
cccagcttcattagagtggtcaaagaaaccattgtaggtgtgaataggaggctgaactagagataagatggtattatgcagaatatgacaagtaggattgcattgcttatctttaataatctctctcttaattgttatcttagaagcaaagttagtttcatcatcgcttaattttaaattaataagtgaaactttgcttccataaggtgagctacaaggtgatggctgaattaaatcttcaacttttttattatcagtccttatttctaggtcatatgacctagaatcttctataaattttctaagcttatttgaagaatccttagtaggtgtttttgcaatgaaacgattattttcttcaggtaagattgtagcgacgctaaccgatgactcagt

SEQ ID NO: 659 - DNA, 398 bp, Artificial Sequence
  Synthetic
tcaagaagaaatactagaaatttaagtgcaaggttaaaagttgacgaattagaagatgaggaagtaggttacagaaaggaaaagacccgaagtccagtaaagaaaacgcccagggccagtagtaaacacgcccgggtaagtgatactgaaacagggctagatcaagacacgagaaggaagtcattgaggagcaaaaagagtgaaacaccatcacatcaccaggtagattatgtcgaagtcaaccatgagacccccgataaacttcccagagaaaaggtagaggaacaacaagatagtgcgttcacttatgataatccatttcaaagcgggagctcacctctattcggaaaaagtaatgaggcaaggagaaaaagtcaaggtatcaataaagaaagaaa

SEQ ID NO: 660 - DNA, 398 bp, Artificial Sequence
  Synthetic
aagctattagcagcaaaactacaccaatcaaacaaagttcaccttcatcagaaagtccagtctttaaaaagaaaggtgggttcttccaaaaccatggccctttccggcgtaaaagtaacaaaggttataataattctcgtactatgacaccatcgaatcgaaatacttggtcttctagatctagagcaaacacaaatgatacttcactgaaggatcaaatatttagccaaagtacaaaaagccaggaaaacaatcgattaagtcgcagtccagatacgataaaccctatagcaaatttgcagctcaatgtagggaacaacatatttgatgtagaaacacctaagcaaagtagccgtgccattcaaagccctgaggtacgaaaagacgaagaattagat

SEQ ID NO: 661 - DNA, 204 bp, Artificial Sequence; identical to SEQ ID NO: 447
  Synthetic

SEQ ID NO: 662 - DNA, 371 bp, Artificial Sequence
  Synthetic
aaatatgagcatatactcggtacattctcttaaaaacttgtcggataatacttggaaacgattttgggaaaggaactccagttttacttggaaatatagcttcattatcgatactactctggacccatcccattaagtgttcaatgtacgtaggggcagccatcttagtcggtcgtttgaaattttcagggtcttgccaaagatattcatactcatcagtcgctttcatctcaggacaggattgcggcgagcagaattctgttatcgacccgtacagtaaattaatatggttgtaaaaatcaaccaagttgacagcaagccattcattttcatcttcaccttcgggtaaccttactatctttcgaaggcta

SEQ ID NO: 663 - DNA, 355 bp, Artificial Sequence
  Synthetic
ttatttgtggcgacctaccgaaaataatcgaagattcgcaatgagtgatgagttagcacaggacgatgaaggttttgaaatatccgactttggagttgaagacgatgaaatagagtctactataggccaaaaagaagatagagatcaaaggccagaagagacgaggtacaatcctgcgccgaaaaattccggacgaaagactgtaaaaaatacaacacgtgagagcttagaaagagaaacgatatttactgttggtgaagacggggacaaatggtcaaataatgatagtgacgaggagcatgttaatctcgttagtgggtcaaacaagccttcttagatttacgacaattttttt

SEQ ID NO: 664 - DNA, 384 bp, Artificial Sequence
  Synthetic
ctgggagttagcagaccaccaatgtatcatagggattcatttgacagtaacttttctgccggaacaacaacctctgtttacttaccaagacgggttgagagtattatgggtgaagaagatagaaaaaagtacgctatagctcaagcgaatcaagtaaggactaacccaaatccgattgggtcatattatccatacggacaagtatatgagatatcagagaatgatataaataacgggacatataaagattcagttgagtcccttcaatcagattcatatggttaccatagatcacactcggccaatagtgtgaggtcgcttgaaccgtatggggaggtaggagaggatcttttgtctcctgtgagctcatctaatcttcccata

SEQ ID NO: 665 - DNA, 387 bp, Artificial Sequence
  Synthetic
tcgggaaagctgattgagccagacgataatattatcaattaattgcatcatcaccggtagacgtggcttgcacataaatgtccattggcaaaatgatttagatttaggaccaagaatagggtgatcggaataatgcggcatatcaatctcgacccctacaatcatatcaatgtctttctcgttccatcgctctggaataaaacgttcaattggacgtaaagcttcgacatcaatgtcagcgtatagacctccttccacatacataatcaaataacgaaggaggtcagctttaataatctttgcattaagagttctgtatgtatggacaatgtcctgtcgatttaagcctgcaggaccaaaatgatgttcaacataatccatgtcatt

SEQ ID NO: 666 - DNA, 360 bp, Artificial Sequence
  Synthetic
ttcggggctatggattgggcaatgcattgctctttatttggtggggatttgtgaatggataattgtctctttaagtgattgggaaaggcaggtaaagatggcttttgaacgaatggatagtcccgaagtattacaagaagaagcacaaaatttatggaacgaagtataacgaaattttgacattttacgtccaaaggacgcgtaaccaaaaggataaaaaaactgagttggcaattatatgtacgtcgcaaagaaactctaatatcaatatgcaacaatcacaatctctttccgagtatccacaaaacgcttcaaatttagcacttcaaacttatcattagatgatacactcatgatttt

SEQ ID NO: 667 - DNA, 363 bp, Artificial Sequence
  Synthetic
tagaaatacctaataataacatgtgagaaaatgaagtgaatcatctacgcaatatcagttctgcctacgaacagcgcttgacccgaaattaaataagaaattgcaattcctacacccttcttagtctaattttgttgctatttagatacacactgtcaaccctcaaaaggaccactagaatcgagcatgagttgcagcttgaatattcgagtatgggaacagatcaaattgtctcagagtctgatctaactaaaataaatgagataaccctctaagaagagatggacaatatgggattatcacagtgtggaattggtgtgacgggcaattatgacactttggtgcatttttatgccttaattt

SEQ ID NO: 668 - DNA, 398 bp, Artificial Sequence
  Synthetic
cctctcgccattaaatactcataaaatatccgcacgtacagttctcttcacttcggtacctgctaaatacagagatgaatctaaattacgtcagatatttggctcatgcgtgaaaaaggtttggataacaaaagacagttcagaggttgacgaccttgtatctgagcgcgacgatctcctactaagattagaatcatctgaagttaagcttattaaaattgcaaatacagagagactcaagattaacaagaaaaaagctggagataataactcatcatctgaagtcgcagctcctgtcccagcatctctagttgactactgggttccagaaaataagcgtccgactcataagcttggcttatttgggctagttggacagaaagttgatacgattaaat

SEQ ID NO: 669 - DNA, 398 bp, Artificial Sequence
  Synthetic
accgtcctgaaagtaaaggtgaaaagaaagagcgtcttctcaaggaagctacagctattaaaaatggcaacaaggaggatgtcagtaagaagccatacacagtaaagtatggactcaatcatgtcgttggtttggttgagaataagaaagcttctctagtcttaatacccaatgatgtcgatcctatagagttggttatatttcttccagctctttgtcgaaagatgggagttccttatgctatcattaaaggaaaagctagacttggtactgttgtacacaagaaaactgctgctgtattggcaataactgaagttcgatccgaagataaatcagagctatcaaaattaatccaagctattaaagaaggctactctgagaaatatgaagaagctaag

SEQ ID NO: 670 - DNA, 397 bp, Artificial Sequence
  Synthetic
tcagcgacaaatcttgctgcatcagtaactttttggatctgaaaggtgaagttttccatatccgcaatcagacgggtatttaccagctggtcattagagacagcttcatgagctgctcctttctccattatcttagagagtgatttgagttttttagtgaaaaccggtatgcttatttcgtacagtgaaggcattttcaaaagtggtgacaataattggatttttctagatgtgtaggtagaaagcagatgtatggtttggacagcatagttaattgggatttgcgtgggctctaatactgtactctgccccgattattcttgaattttgcagctgccagttttatttgaagaatccttggtatttccaaatcaagcggatctaaaataattcgatt

SEQ ID NO: 671-685 - skipped (15 entries)

SEQ ID NO: 686 - DNA, 395 bp, Artificial Sequence
  Synthetic
taacgagagagaatacacggtaaagacagtagtatggcatatgatgcaaaatgtagaaaagattgtaattgagttggcagtaagttcattcacgaaaaatgaattattttccacaccatatccgggctgaggaaggaagacatttgttttcaagtcaagttaatgaaaaaaccaaaaataaaactcaaacacacagtgagtaatttttattaaggtggtccaataataattttttctgacatgtactccttgtagttttgagatgaaaatagagataatattgagtctgtcgttatccgaaacagtttatgttagaggttgataaatgacgatacaaaatgtatatattaggaaatcaatttaccgtgaccaatgagaaaagaggaggtctaatt

SEQ ID NO: 687 - DNA, 398 bp, Artificial Sequence
  Synthetic
tcaagtccacttcgatttgtaaagcaagaagttatgagaccttgagaatgactgaggtaggccgaataagattttcagattctaaaatactggattttggtaccaattcatgatcctttctggcccccttacattggcgacaaggcagatagtcatcgagttggtcttttccagtcaaagaatgataatctccaacgtctttccgggaaacagaagttgtattgacattaattacagctgtggatgaggatgaacgataatattggcgttgagctacagggaagggattcaacagatgccattgccattcataatttccatgaagccaagtcgttgaagccagagatgcaagtgtatggaagaatcccaagagccaattgattgaagacagaattact

SEQ ID NO: 688 - DNA, 379 bp, Artificial Sequence
  Synthetic
ctggaattgttgcactggccatgtaaagcagtttatgactcgtctaaatatttaattacggctatgcacggagagcttggggttactgtttttttttctcaaaaatatgccggtgggattcgaattggtccggatattttttctgtaaataattgagtgacggctttgtactcgtgataattacagacaaatctaatataatgtgcttatccttctaacgaacttcggagaatgatttgttttattgagtgattagttgacttgttttattagttatggttatcaaacgatcacataaaaaaacgcatactttttacaatgaagtgattgtataccaatgtttcccttggtggccctcaaaaaactaagttagatagat

SEQ ID NO: 689 - DNA, 396 bp, Artificial Sequence
  Synthetic
tatccctgatttctatagtctgatgaagaatgatttttgtaggcaatagactttcttctcttcccagaacagcagcttctacagcatccacaacagcttaggaaagagaagcaagaacaacaaaatgagtatccaaagcacaagcagcgtgtcatacaaatgataattgagaggactattaagccaccgataacaagtccgattattgctggccatttgcaataaatttgtatcatgcatttatcccagttggtgaatgaagaagtaacgtttgatacttgattagttaattgatcactcaactgatcacttacaagccttggcctaagcaaactaatctccaaaaaattcatgtttccaatattaacacctccgtgatcttcattaaataagtaa

SEQ ID NO: 690 - DNA, 250 bp, Artificial Sequence
  Synthetic
gttgaaaaagacaatatttcgaagttcccgagagctttcgtatccggcaatgactgcatcacgtcgaatttctacgatccaagacgaaaatagtttgtttttttgctgttggcgtggagtctagctgttgtgtacccgaaccctattcggatcatcaaataggattgtaagttggttcatcattttatgaacagattcaaattgtattaccccattcttaatcaataccatgcaggtgtgactgacagtc

SEQ ID NO: 691 - DNA, 400 bp, Artificial Sequence
  Synthetic
caattgctgcagcatgaccttctcttggaaccggtatatatcctatgcagtccaaaagagtccaggagttcggtatcggatcataacaccaaacatcgttataccattgaagaccatttgttccgccaaacaagtaaagcttttcattatatgtcacaactgagtgatttgttctagctgatggtatttgtcctactgggggtccaccatcctcactatttttaatgagaatttcccacctgttcgtagggacttgcaaaagattcaaatcaaaagccacaaggtcattcataaaataaccctctacttgccccccgaatacgtagattttagaccctagtatattgagagaatgaccataacgccccgcgggccgtggcccggcaggtatagctctgga

SEQ ID NO: 692 - DNA, 350 bp, Artificial Sequence
  Synthetic
cttggaaccggtatatatcctatgcagtccaaaagagtccaggagttcggtatcggatcataacaccaaacatcgttataccattgaagaccatttgttccgccaaacaagtaaagcttttcattatatgtcacaactgagtgatttgttctagctgatggtatttgtcctactgggggtccaccatcctcactatttttaatgagaatttcccacctgttcgtagggacttgcaaaagattcaaatcaaaagccacaaggtcattcataaaataaccctctacttgccccccgaatacgtagattttagaccctagtatattgagagaatgaccataacgccccgcggg

SEQ ID NO: 693 - DNA, 300 bp, Artificial Sequence
  Synthetic
agtccaaaagagtccaggagttcggtatcggatcataacaccaaacatcgttataccattgaagaccatttgttccgccaaacaagtaaagcttttcattatatgtcacaactgagtgatttgttctagctgatggtatttgtcctactgggggtccaccatcctcactatttttaatgagaatttcccacctgttcgtagggacttgcaaaagattcaaatcaaaagccacaaggtcattcataaaataaccctctacttgccccccgaatacgtagattttagaccctagtatattga

SEQ ID NO: 694 - skipped

SEQ ID NO: 695 - DNA, 350 bp, Artificial Sequence
  Synthetic
gtaacaatatcaccatgtttaaccctaaggttgtgtcggacaacacgattcatacgagcactcccgtcatctaaatcatcatctgcgagtacaattaaaacagtatcctttcgcttcttccccttaactaggacagtatctccacgaaaaagctgcaaagtttccatggtattatttgacagtgcaataacagagttatcatcgttgatggcatctgttacaattaaggaatttggctttttcttcttttttaaaatagcagtcgcagtagcatcaatcgtcttttgttcagcgccagaggcatcctcaagtttaactgtttttttacgagtagcattgtcttcagacat

SEQ ID NO: 696 - DNA, 300 bp, Artificial Sequence
  Synthetic
taaggttgtgtcggacaacacgattcatacgagcactcccgtcatctaaatcatcatctgcgagtacaattaaaacagtatcctttcgcttcttccccttaactaggacagtatctccacgaaaaagctgcaaagtttccatggtattatttgacagtgcaataacagagttatcatcgttgatggcatctgttacaattaaggaatttggctttttcttcttttttaaaatagcagtcgcagtagcatcaatcgtcttttgttcagcgccagaggcatcctcaagtttaactgtttttt

SEQ ID NO: 697-698 - skipped (2 entries)

SEQ ID NO: 699 - DNA, 350 bp, Artificial Sequence
  Synthetic
ctgtcaatattacagcttgatatgaatcaaactgggagagatcagaaactaagcttgtggagctgtgaatcttaacaggggtgtaagcatttagttccgaaactcgttgagctgagacaatatctctaggttttcctatatcttctgggttaagaaagaattgagatgataggtcagcgatagttgcgggagcgggatcgtataatgttagacttttaactccagccagagctatattcttagctatttcgataccaagacctttcaagccaataataagaatattcgatgcactcattcgtttcatagcctcgtgtccaagaacgtagagttgcctactgtataaagac

SEQ ID NO: 700 - DNA, 300 bp, Artificial Sequence
  Synthetic
atcaaactgggagagatcagaaactaagcttgtggagctgtgaatcttaacaggggtgtaagcatttagttccgaaactcgttgagctgagacaatatctctaggttttcctatatcttctgggttaagaaagaattgagatgataggtcagcgatagttgcgggagcgggatcgtataatgttagacttttaactccagccagagctatattcttagctatttcgataccaagacctttcaagccaataataagaatattcgatgcactcattcgtttcatagcctcgtgtccaagaac

SEQ ID NO: 701 - skipped

SEQ ID NO: 702 - DNA, 400 bp, Artificial Sequence
  Synthetic
atgagctggtctttcagtggaatatctgtcaatattacagcttgatatgaatcaaactgggagagatcagaaactaagcttgtggagctgtgaatcttaacaggggtgtaagcatttagttccgaaactcgttgagctgagacaatatctctaggttttcctatatcttctgggttaagaaagaattgagatgataggtcagcgatagttgcgggagcgggatcgtataatgttagacttttaactccagccagagctatattcttagctatttcgataccaagacctttcaagccaataataagaatattcgatgcactcattcgtttcatagcctcgtgtccaagaacgtagagttgcctactgtataaagactcatcgataacattattattttctt

SEQ ID NO: 703 - DNA, 350 bp, Artificial Sequence
  Synthetic
tgtagccgcaacagtttcagctgtcccagctagtccttctgattgaagtttatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgaggttcgttgcgggcctgaagctttttaaccatgaattttggaataggacgca

SEQ ID NO: 704 - DNA, 300 bp, Artificial Sequence
  Synthetic
ccagctagtccttctgattgaagtttatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgaggttcgttgcgggcctgaagcttttta

SEQ ID NO: 705 - DNA, 250 bp, Artificial Sequence
  Synthetic
tatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgagg

SEQ ID NO: 706 - DNA, 400 bp, Artificial Sequence
  Synthetic
ttaaaagttgcggtttaacttaagctgtagccgcaacagtttcagctgtcccagctagtccttctgattgaagtttatcattagtaatccctttagcgatggcgccattagtaccttcggttgagttgccaacattagatacttcgccagcaccatcagatacatgtgtagttaattcttcagaggtcttgtccggactatctattgcgatctttactgcaatctcacgaccttgaacttcttttccattcatttcggcaacagccctattttgaagttcattagatgctaagttcacaaagccaaacccacggcctttccgaggttcgttgcgggcctgaagctttttaaccatgaattttggaataggacgcagagcaattttggcagatactggttc

SEQ ID NO: 707 - DNA, 250 bp, Artificial Sequence
  Synthetic
tcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaactatgtagcttcagtaagtgctcaatatcaaggataaattggcgatgtagtcatatatgtc

SEQ ID NO: 708 - DNA, 400 bp, Artificial Sequence
  Synthetic
cgtaagcctttgatgggttcagaaatgtagatacagattcgtatgcgagaagttgaagtgctgtaaatggtacagtcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaactatgtagcttcagtaagtgctcaatatcaaggataaattggcgatgtagtcatatatgtctgattccttaatcaaaattcttaatacagacctgctgcaataggatgatgagctcctgtttgattacctcccatg

SEQ ID NO: 709 - DNA, 350 bp, Artificial Sequence
  Synthetic
tgtagatacagattcgtatgcgagaagttgaagtgctgtaaatggtacagtcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaactatgtagcttcagtaagtgctcaatatcaaggataaattggcgatgtagtcatatatgtctgattccttaatcaaaattcttaatacagacctgctgcaataggatgatg

SEQ ID NO: 710 - DNA, 300 bp, Artificial Sequence
  Synthetic
agttgaagtgctgtaaatggtacagtcatggaaagagtagttggatacgagatatagaaggctgtgatgccttcagtgcgatagatatagcgggcacaatcactcagtgatctataaattttgcgagagttatgcatttgcattctttgctttattacatcaaatgggttcattaaagcatcacttgcaattgttgcgcatgccccacttgtaactatgtagcttcagtaagtgctcaatatcaaggataaattggcgatgtagtcatatatgtctgattccttaatcaaaattcttaat

SEQ ID NO: 711 - DNA, 400 bp, Artificial Sequence
  Synthetic
atgaagtgcaggatttttctctataagtttcttacgttgtagcgccgaagcttctctaagtttaatctctgatggagataaaacgttatatataggcgtaccaacagcaattgtcccctctttaagtagatataactttcgcttatctttgtctcggtcagtgcggaagtttgtcccagcttctgtaagttttacagctttttctcgattaactgctcttgacacttgaagtacgcgaccttctattgtgtataagccattcttatcagcagtttcatcctctaaaatagagtttttagctttaacagcgtttgcaccacttttgaaggtacgaggtgcaccatggtaacaagagtccgcatcttcttgtctatagaagcaaacaaagccagtgccttta

SEQ ID NO: 712 - DNA, 350 bp, Artificial Sequence
  Synthetic
agtttcttacgttgtagcgccgaagcttctctaagtttaatctctgatggagataaaacgttatatataggcgtaccaacagcaattgtcccctctttaagtagatataactttcgcttatctttgtctcggtcagtgcggaagtttgtcccagcttctgtaagttttacagctttttctcgattaactgctcttgacacttgaagtacgcgaccttctattgtgtataagccattcttatcagcagtttcatcctctaaaatagagtttttagctttaacagcgtttgcaccacttttgaaggtacgaggtgcaccatggtaacaagagtccgcatcttcttgtctata

SEQ ID NO: 713 - DNA, 399 bp, Artificial Sequence
  Synthetic
gtttgcctttccaaatatccatcatgcagctttgtaacgtacctctcgtcctgtttggtctcctctgctttggactagtttcaactgctccagcaccaaactcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacaggtacaggtggttacgcatcgccaacagggaccagttaccctacacctactggaggttactctgaagagccctaccactataaaggtgtcaagctaggtc

SEQ ID NO: 714 - DNA, 349 bp, Artificial Sequence
  Synthetic
gcagctttgtaacgtacctctcgtcctgtttggtctcctctgctttggactagtttcaactgctccagcaccaaactcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacaggtacaggtggttacgcatcgccaacagggaccagttaccctacacctactggaggttactctgaagagccctac

SEQ ID NO: 715 - DNA, 299 bp, Artificial Sequence
  Synthetic
ctgtttggtctcctctgctttggactagtttcaactgctccagcaccaaactcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacaggtacaggtggttacgcatcgccaacagggaccagttaccctacacctac

SEQ ID NO: 716 - DNA, 249 bp, Artificial Sequence
  Synthetic
tagtttcaactgctccagcaccaaactcaccttggcatctacgaagccgacaggaaggtggtggctactatggccaaccatcgaatggtgatggaagtgtgtatccaccttcatctggtacaggtggctttctatcgccaactgctacgagcggttatccgtctgcaactggaactggcggctattcatctccatcgggcaccggtggctacccgtctgcaacaggtacaggtggttacgcatcgccaa

SEQ ID NO: 717 - DNA, 397 bp, Artificial Sequence
  Synthetic
ttcctggacaaccagtaaagaaaaagttgggaccaaatcaaacacaagaaatgataaagtttgcatgtcgaacacctgcccaaaatgctacctcagttgttcaagatggaagacatgttttgagcctgaactctagcaaccctgttctatctgaatttggccttcaagtaggtcagtctttgatatcagtaaatgctcgagtactacaaccaccgtctgtgagatatggaggatctggaagtctatcaccgagaaatggtagttggaatatgattaacgtgagatttcatacacccgccaaaatcggaccatggacttgtattatgtttcccacccaaggaagaaatgacattgatgttggtaatatgagatcacatgtcactgctttccaagcaca

SEQ ID NO: 718 - DNA, 397 bp, Artificial Sequence
  Synthetic
aactactaacctcgccgccctatataagaagatgggaacgcaaaatcgtgtcaatttgaaagaaaagttaaaaggaatgcgaatccaaatcacacatctgcccccaaagattaataaaacaaccggaaaggttataccaaggattaaaaccattcaaggccttgcaaatattaatgatggtgccaaagaggagcatcgaccagaggttgctggatatggtgctggtcctcaaaaggtcaagttttgggtatctgaagatactggcacttctaaaaccagccaaaaaaaccccttgccatctaacacttacatcagtgtatatgattacttcaaaaaaagatacccaaagattgaattggatccaataaatcctgtagttaatgttggaaacagtgaa

SEQ ID NO: 719 - DNA, 351 bp, Artificial Sequence
  Synthetic
atctgcatcaggcagctcgtaatctatgtaaagaacgaaaccgtcagttgcagtggaatatttttcgcgatttaatacagccagttcgagatccgaaggatggtaggtggaaaaaatcagaggattggaagaacctacagaaaatggctagattacagtttaccgtcaaacatcgagggaaaaatgatgatcataaagtctattatataaaaggatttactttctctggtgagcaaggtggtgctcactctaaaaacacatactttagccttaaaaatagaaaaaccgaccctcctacggaagagaaaatatctgtatatgattattttaagaaaacttataatatcaata

SEQ ID NO: 720 - DNA, 349 bp, Artificial Sequence
  Synthetic
ctcccccagggagtaactatacctgaagggtggtcattacttcctcttcaaagtattgatgaaacgattctcacacagagtactagaatatcacctatggtattaaatccaaccctaaactcaatgcctgtgcctgatactaattcaggcactgacctaagtggttcaaagaatcatactgaacctgattctggattgaaaaactcgcctttaaattcctcgacgggttcagctagtaaaaacttgaaaacaccagcgtctagttcgagtaaaacttcatcgtcagtcatagaagaaaatgcgaatatatgattattactctattgtaacccctagataactatgtaat

SEQ ID NO: 721 - DNA, 342 bp, Artificial Sequence
  Synthetic
ttacaatccatgcaccatccattaagcgaaaataaaccatcactgttgagaaagaagttaaacgtgatttgagctgttataagagttgagtttaacacagtattttgaatttgttctaatcctgtacttgctatttttgaatcttcgagtgatggtgcaagatcaacgttgaagtgtatgatagaatctggtgcagtttcggtacttaagtacagatatgttgcaatgccaaaactatcactagcaccacgcatagcaaagaaaatatcgggatttgtatcatcactggcgaaaatttcctgtccatcagcaagaataacatccataccaacgatgtgatca

SEQ ID NO: 722 - DNA, 398 bp, Artificial Sequence
  Synthetic
ccaggctaaatctgtgctccaaacacagtcagtaatacagactttaattgctgagtgtttatctttggggaaaacaaaaatgattattgatctctcctcgaatagtggaggtaatttggtcgttggttatgacacattccgacaatttttccctaccattgaacagccaggttattcacgatttcgattacacgaggcgctaaaaattattacgaaacagatctcgaaaatcgcatcgaatttctcttttacaagtacaaaccccactgattatgattattaccaaactccgtttaattatagattcgatctaaatgaaaccaatgaaaaatttcttagctacgaggataaattcagtccaagaaaatttaatggtgatgaattcactagcaatatga

SEQ ID NO: 723 - DNA, 396 bp, Artificial Sequence
  Synthetic
attgcgccaaaatgtgaggtaaggattactaacttgctgagcttgaagaactcatcaacaccagtatctttagctggtaaacaagttaagcaaattcaaagcaacttaccatcgacaagtaaacaacttggaatatttgcaaaagaaaacatcttaccgggcgaatcaatccttaaagagctgtcatatctcactgttaataatagactcaaaggccctctatgtgatgcttgtagtgctgaaattccttctctatatgaaactgaaagtacagcaatgagctgtctcgagtgtgatgaaatctcattctgtagtgatgaatgcaaacgtggagctgagctcgaatatcatccagcagtatgtggtaaagatgttgagacaattggcaaggactgg

SEQ ID NO: 724 - DNA, 306 bp, Artificial Sequence
  Synthetic
tcaacgtaaattttataagcaaggctctggtaaagtggaaccttactttttaatcctcaacaaggaaggagagttcattgatgtagtcgttgaagggctgatgaataacttcataagatgtcaacaaacaagaaaaatctctacagaattaatttcagatgcacctaatcaaccggtaccatctcaaatatctggatatcaatgtggtaaatttttttttagcaatgaggaacttgagaatactgcaaatgtggctagagatatcatgcttcagagaagtcaaaataaaattcccactaagtataa

SEQ ID NO: 725 - DNA, 327 bp, Artificial Sequence
  Synthetic
ttcgcggtgtcttcctttccagagcctttagtctttgaaggattttcttcttcatccccatcttcaccctccgcttctgcattgacttcgtcggccttttttgcttttttttcttccccagatttgcctttcgttgttagagctcctaggccactagcgagagaatttgaaccattaccaccgccaacaagaactcctgctttacctcctatggtcacctcttgaatactctgactttcattttccgcagcattggcttgctttttggaagatgagctagagtcatgtgatttttctgaattcgatgccttatttttctgatctttt

SEQ ID NO: 726 - DNA, 393 bp, Artificial Sequence
  Synthetic
cccgaatgaatgctatcaacatgggatagtagttcacgttcactccgaaattttatattacaaaacatacactctgcatgttcttttcgaatatgagcctgtaactttgaataacttgtgaagcctagatttaatggcgtaccatctgaattaaaagatcctgtcaagcaacattcattacagaaatatcgagcactgccatgagctcgctcttggtgtcgacgaaggctggcggaactatcgaaacctgagttgcaactttcgccagtgacagggtcaacatggacacagggatacggcataagctgaagatgttcagagcgaatatgacgctggagagtttgatgttttcggaaattttggctacagggtgggtaatttgtacatttgaat

SEQ ID NO: 727 - DNA, 398 bp, Artificial Sequence
  Synthetic
tacagtgacaacgctactcgaaatgttcttgactgcaaatcctgataagtgtcgaagagccgaagaactggaggaattaaagaaaatatactgccgtggcgactgtgtattacctaaggttgttaccggagaaagggagttttcatcacgacaaagacgagtagaagactccgatagaagccttgtcgatgaaattcgtgagataagtttacgagaagcacttacagaaaccccaaatattcgaagagggcagaaccgacgagaccatgaggattctagaaggcctagctcctcaagaactaggcatacaaccccggaagctagaattgctgacgagcacaatcacactaggagacgaagaagagaagagcgaaactctaggcaaagtcaagaaaaca

SEQ ID NO: 728 - DNA, 398 bp, Artificial Sequence
  Synthetic
tttgggttgttagtactatcatttgtgacacttatctttgattcagtagatgagttagatggggaattcacattgactgctatcggttttagtacagatggcgatggtgacttggacttgtcttttttcatagtcattgtagtttgggaattcacaatgggactgttagatttctccctctcctctcgcacgaggttatttttttcttcaagatactgctgtatctcaagggacatagcttcatcatgtataagatcatccaacaatacaccttcagtctgacaacctggacaggtaaagtcgctctcgatgagcgagttagtaatgcagtcattgcagtacgttttctcacaacatggcgttttcattggatctatgaatattctcttgtcgattga

SEQ ID NO: 729 - DNA, 348 bp, Artificial Sequence
  Synthetic
tttgaaaaacacacaaccccagaagaatacgatagcatatcattggccaagcaccctcagttgcatgttgaggatgattcatggcatagagcaactggtacttgtaagtgtaataactgttaatgaagtatataatcccaaaaaatagaaccatataaccagccggtagaattgagtatacaatacacaaaatgtatacaaggattgcagagggtagataaaacccgtatttgaagacaggaggctgtgtaagctcccagcgatccctagggctttttgaatacatacgcataattggatatagagacacactgccaaactctaagagccttaatggtatgaaaccaa

SEQ ID NO: 730 - DNA, 398 bp, Artificial Sequence
  Synthetic
aacaaggaaatctctaattctttcaatagctttacaaatgagagtttcaagaagaggttttaagctgattatgcctttaatatttcgtcgatctttgatttttgagtcaaatgatttggaccttttttcaacatcagccaatgcttttacccatgcctcgtccattgatccatcaacaattttcctaacagttgctattggaatgctgatttcttcaacaataggaccgagtatctgttcagtattctttcgattatctaaacttatgcttagagcatttgaccgggcctgtatcgtttctatatcaacagagacttgcgccaagtcatcccgaaaggttactaaattcgattcaactgagcttaatacttcatcgcaagcaagaatagaattgtgta

SEQ ID NO: 731 - DNA, 396 bp, Artificial Sequence
  Synthetic
ctgaatcagatgatgggggtaatgaacgtatgataaatagtaagaaaccgcgaagtacatgctcgaagaccctaagggaaaaagatttgaaagatgataaagaaaagtccagatctgatgctgtagctaaaagaaatggtcgtacagagcggagaagaactgaagatcaagaaacacagaaggaattgtcaattggtactaaaaatacaatgtgcaatagcacagactcttctaaagtctctacaacgattgaatctcttgagtctccgacattatcaaatggtagagtttcagacaattcatctaacaaccaatttccaatacctttaaaaaaaagctaccgtaattcaaattctaggaaagggaaattagccaaaaataatttcacaagggaat

SEQ ID NO: 732 - DNA, 381 bp, Artificial Sequence
  Synthetic
ttgaagtggttaaaaaacatgttgaggaaacagaatgggaagaagaaccttccaagaatggaagacttgatattgatataataaccgcggaagcaatgacacttgctcatcaaattgcaagtggtgagaagactaaatatgatctcatcgatgaaggttggaataaaaattcattcaaggatcgcgatggccttcctgattggtttctggatgatgagagtaaacatgataaacctcatagacctatcagtgctgccgctgcaaatgctataaaagaaaagctgcgagccctgaatgctcgaccaatcaaaaaagtacgtgaggctaagagtcggaaaaaattcaaagctgcccaacgacttgaaaaactccgaaaaaaat

SEQ ID NO: 733 - DNA, 392 bp, Artificial Sequence
  Synthetic
attgttgataagttcactggaaatctccgttataggatctattccttcattttgtttccggagtttttcttcttgtcgagcactcattttggtagagaatgcccaacatgaaaggcccaattcgcgacatactatgcacacatctagacgaggcgcagttttgtctttcgttatcgcaattccaatgcaacgacgacattgtaagacaaaattctcatgaccaattttagtaaccaagtgatctctgttacttcgaggaccaagacaatttttgtggattgaagttgagcatccttgacagtaaataagttggcttgggcccttgttcgaatttctctcatttccaaagcaaacatcacaaaatttattatgaaaacttcgaaataaatttt

SEQ ID NO: 734 - DNA, 393 bp, Artificial Sequence
  Synthetic
ctaacgagtgatcgaagcccatctgaaagattttgagttatgcttttaccaactattacagtatctgagctcagtcgcgagagtaaatccccgactcgattggcgtcaaagaactcggcatcttgtacaaatgtccttcgaaataattttgatcggagtcttgaaattactctttctccaactattctcagaattaatatccgtccataattagctacagcacctattgatagtataagcccaagagccccgaaaaattgttgattattaagttcaaaaagtgtgtttccttctgagtttttggttgcaaggtctaatattttaccgattgaaaaaggaattgccattgatatggatgaagatactaataaaaagaaaaatgccaaactgagc

SEQ ID NO: 735 - DNA, 391 bp, Artificial Sequence
  Synthetic
atcaatttttcattctccctaatagatttgatatcccgttctttgagataacttaattcctcttttatgtcttttagctttttttctgcagtcgcaattagagtctctttttcagcaatttgatcttgaagctcattttctctttttaaaaactcttcacgatcatctttttctaatgcaattggcgtagatgagcgatctaataacgttgaagcttccgatctagattctacctgcagcctagaaggagttgcaggtcttggtgtttttattttagaaagattagcagtatctaaaggtggtacccatttttctttaggcacactatctccagacctccactgctgaacttctgcatcaagtgtctgtacatattgttcaaatgtagtaa

SEQ ID NO: 736 - DNA, 398 bp, Artificial Sequence
  Synthetic
ttcctatcgaatttgtatcgtttaccaactttgggttactgagaggaaataaactagcgggattcattatcaattgcgaattaagtagtctctgtgggataggtgagtttggtcgagaatgcgtaggtaatgaaaaattaatagactttctagaaatggaaaggcttggacttggaattgggtattgataatttgaaatgttaggtccgccagaagattccacacgcgcattagaatctatggttaatttttgtgctgaagttttccgggtccgcagtgcttcattttttttcaatacacttttacttttcggcatgtcttgaacaataaggtcgggcaaagatgggataggaggcatgttcacttgagaccatgtggaggataaatcacggaatgag

SEQ ID NO: 737 - DNA, 394 bp, Artificial Sequence
  Synthetic
tcttcttcagtggtatgtgcaagagattgacgtctagatgaacgtgttgatggtgcagttactacagcagtagcttcaaccgattttcgactcacttttcgcttgtttgaaacagacgaaactaaagaatttgtggaactagatttaggtttacgagtagtggaccgtcccttacttgtatagactctctttttaagtgtagaatcattcaatggctgtaaaaatgaaactaaatctccacaaatagtagtaggtgcatctgctgataatgcttcaggtaaatctaatctagatccaatttctgatgtactaagtgatatatttgaagaggtaatattactttgtatttcaggtgtctttgaggtcatctttgatgaaattaccattagttttt

SEQ ID NO: 738 - DNA, 398 bp, Artificial Sequence
  Synthetic
caccgcaggaaacaacacgagtaaaatcattttcttcaacaacatcttctgcagcaaaaaaattttctcgtgcactcttatggcggtcaatttgtagagattgctcatcgaagacaatctgaccatcaacgatgcgaattttaggaccaaccggaggagcagacggcggtgcgatttggctatttaaacttggctcagtctttctactttcatttagggtataattgtcaccactttttccatctatataatcttcaagttcagggttatctcgcttcatcctagctttgatagcattttgtttcattcgtgcaagtcgtcccattatctcatcgtggtttctagactttttaccaatacgaagatcatgacataagtcttgcatggtaataacagaa

SEQ ID NO: 739 - DNA, 391 bp, Artificial Sequence
  Synthetic
tcgaggttctgataagacttgatctaaagtagggaagagagtttcatggcgaaaatgccatcgatagggtgtatgaagcggtataattggatttagtttattatcacatccaatggcaatactggtttcgtgcgcccaggctctagctacatttcttggtgtatagcctccacctccgagtaataatagaggcaggtttaaagatttgcaaaatgcaacgcaagctccatggccttgaacttggacgttgaagcgcccaagtcgatcaccagcaagggagtcagcaccacattgtagaacgagggcggtaggtcgaaacttctcgacacattttcctacaacggccttaaagaggtaaatatattgctcatcatcaataccatctgcaaga

SEQ ID NO: 740 - DNA, 398 bp, Artificial Sequence
  Synthetic
catctcaacgactttgtagaataaatcatagtgagatacaggactgtgtagaaatgcctcaccacaacataaagataaggcaattaaattaactagattgtcaatcaaaatatcaatattttttaagcccctcaagtctgatgtgtatgtggtgagaaaccgaacaagagaaagcagtgatctatatagttcagaccagtgatatttcaatcgtgtccgtgaccgagataggtatgataatatactataaatgataccaatgcaaagaatatataaatcaacatccagtcgtcgtcttagattgtgattgattccatcaagcatcgcatcaagaagaatagcagcaatcgatctatctccatgaacataaggaaggtacggagatttttgtcgacata

SEQ ID NO: 741 - DNA, 392 bp, Artificial Sequence
  Synthetic
atcggcaaaagtaatgcttcaaaagctgatacaaagactatatggagaggagctttaaatatattggaagacttaaaaaacgcagaaaaggattggagatttgggaaaactgaaattgtagggtttgacattgagagagagaaccaaatagattgccctcaaagtgatatggaaatcttgcagcaacagtcaagcaacactgcaagctatgccaataatttcacctccgaccttacacctgaaggccgcccaacaggaaaagttacgaaagctcgatttcagtctgcagaaataggaaaatgtactcaagttggatggggagtcgtacacctataccgtgatgataacgatgctgttaattttgatacccgaactactacatacgatggaaa

SEQ ID NO: 742 - DNA, 395 bp, Artificial Sequence
  Synthetic
aagattgaaaatggaacgcctagaacagcacctttaattacaacacgaaggactccgaaaatgctacgatctactgtgtcaaattcctcgctttcctcacaaccatcaatgtcaccgcatcaatttattgctcttgcccgggaagcaatgaaaaatgctttggaagagaacaaatcaaaggcagctgaggccaaaagtgttagtaatgaacttaagccaggggttacgatcgattttagcaacaaacaaatccaacgatttcctgatgaagtaattgatataataaagaatgagcttgaaagacttgcgctgtcacataatcaaatatctgtgtttccctcaaggttttccgaatgcaaatcactccgatacctcaatgttagagataatgttat

SEQ ID NO: 743-757 - skipped (15 entries)

SEQ ID NO: 758 - DNA, 200 bp, Artificial Sequence
  Synthetic
aaaagttatggcggaaatcactatatatactgcttcacatgccttacaaggagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctagga

SEQ ID NO: 759 - DNA, 200 bp, Artificial Sequence
  Synthetic
atgggatttacaccgatcaactttacattttactgggcacctctaccttggaatcgtgctcgtgatcatgcccaaagaactgttgctaggacttatatgaatataatccaagctcgtagagaagagaaaagaagcggtgagaataagcatgatataatgtgggagttgatgcgttccacttataaagacgggactccggt

SEQ ID NO: 760 - skipped

SEQ ID NO: 761 - DNA, 311 bp, Artificial Sequence
  Synthetic
tgccattcgcgtatttttctattcgaagacactcagtccttcagagattattccagaattgtatcctcaattacaatcttatttttacacaatacctctttcccctaaataaagtactacaatgtcaaattccgaattagcagtttcgtatgctgcccttatcctcgcagatgacggggttgacgtcacagcagataagctacaatcattaatcaaggctgctggtattgatgatgttgagccaatttggactactttatttgccaaggctctcgatggcaaagatgtgaaagatatgctcctgaatgtag

SEQ ID NO: 762 - DNA, 397 bp, Artificial Sequence
  Synthetic
gcccgcttcctcagctattcttgcctgttttgcgttgaccacatccataattacgccacccttcaacatgcgagccaggccggttttgaccccaaaattcttttgtcccacaggctttgaggtgcctttattgattccattattaacgccaccatcagcagagacaggaatagggatttcagtggccatcttgcaattatctcataaatagtggtattagttaagcgcccgaaggttcttgtcaaattcttcttgcaaatattagtatcaagagtttgctgaagatataaaactaagaaacgaattgtaattaacaaatggattgtaaaatttctcaaaatgaccgcctggtcgatatgactatgacgtttagagccaggaagtgttgcaggaaaaa

SEQ ID NO: 763 - skipped

SEQ ID NO: 764 - DNA, 398 bp, Artificial Sequence
  Synthetic
gtcgtaatgatcttggccaataattcgagggtcaagcattcgagatttagactcaaggggatctaccgctggatagatacctaattctgaaataccacgtgataatacagtagttgcatctaaatgagcaaacgttgttgcgggtgctggatccgtcagatcatcagctggcacgtaaacagcttgcactgaagtgattgagcctttggtagttgttgtaattcgctcttgcataagacccatatctactgcaagtgtaggttgataaccaactgcagagggaatacgtccgagaagagcagagacttcggagccggcctgagtgaaacgaaaaatattatcaatgaaaagtaatacatcttgtccttcttcatcacggaaatactcagcaatagtta

SEQ ID NO: 765 - DNA, 398 bp, Artificial Sequence
  Synthetic
ccggtccaactcaagtcagcaagcttcagccagaacaaaaggatggtaagttaaggcatcttccatttaaatccaaactcttaaaatcttttaatatttgatacaagtgcgcagaaatgcaaagtgaaacttgagaatttttgcaggatgttcggacttgattctgaaatgtgaactgcggattcgaaaattatgagctaacaaacaacagccgttcactaagttagttaaaaattcagcatacttcagtcgataccaaactaaatacaagcggcgtcggattggaaagactgactactatgctcgtaagcgcctcataacacaggcaaagaacaaatacaacactccaaagtaccggcttgttatccgatttaccaatcgtgatatcgttgcacaaa

SEQ ID NO: 766 - skipped

SEQ ID NO: 767 - DNA, 275 bp, Artificial Sequence
  Synthetic
ttcggcatatcaacgtaaaaaaaaaataaatcgacacaaaacagctcaataccgtagtttatcaccatgcttacaattacgtaaacggaggtctgcaaagagccttaagtctttggaaatatcatgcagtagtggtattgaaaaaggaaccactagcttcgtaaactataccccagaagattcccagaagattttaaatggagttgctccgtctgggagtaacaagaccaaagctcgaagggagaaagaggccttggaaaaacgccaaaagttat

SEQ ID NO: 768 - skipped

SEQ ID NO: 769 - DNA, 391 bp, Artificial Sequence
  Synthetic
ttcctagtcaaacgtgcatctagtggaggtgtacaattttctcgtgatcccctaaacttaacaaatgtgcattctcgcaaatatgccggatttgttaacgataaggctgtcggaattcttcccattgaaggtggtaaaggaggtattactttgatcaccaaaaaaactaaatttacccaaaaaccttctagcgccatatacacaacagtttttggtggtaataaaacttcaagacggacatataagggggttgtcaatactgttgtcaaatcaagatatcgatctgatcttcgtgctgaagctgttgctcgtgcgtctgctattcggtactcgcaaaaaccaaagggtgatcttcctaagaagaaattgcgtggatcaaaagctaaaaagg

SEQ ID NO: 770-771 - skipped (2 entries)

SEQ ID NO: 772 - DNA, 240 bp, Artificial Sequence
  Synthetic
ttgagaaattattttctcttatagcgaatttgattgagtattttatgtgatattcacgttgttggacccttatagatctgggatttagggtcttagaagactcgtcttaaagcttgccccaacgtatgaagtattaaatacgttacttttgatatgaatatattttttatatacacgaattaatttaatcgaagagaccaaagcccatatcttcatcagactcttcttctttttcttctt

SEQ ID NO: 773 - skipped

SEQ ID NO: 774 - DNA, 339 bp, Artificial Sequence
  Synthetic
ccgccatactgggggattagaaccttgtcgccaaccttgacattacaagacactctgtttccatctttgccaactgcaccaggtcctacagctataacgtgggcttcattgagttccttgacacttttttcgggaagaaaaatgccactcgcagtctttgcttctgccttcactcgttgtacaagaacccggtcaagtaaaggagcaagggacttgattgatttgagtgttgaagccatgttagaggataacggacagtgaattataaagactgtgcaataaaattggtttaagagaaaagatctttgaagtcgcgttacgttaaagtcgctatctgtt

SEQ ID NO: 775 - DNA, 398 bp, Artificial Sequence
  Synthetic
tactaacaaactgtccaccaaaagtatatataattcctgcaactgagggagtagatcgcttgcaaataaaatcaaaatctagcattccttgaacagctctaggctgaagaccatagacgaaacatcttgttttatcatggaagagtgtatgagttgcgtgagggctcaatgggcggctaggagcagcaaaccgacagatgttatcattggctgattgcccaactttcgtagtatcatttggagtagctgatggcattttaaaatattacaaggtcacagagtgtaattttgggcctgatttcttctgtagagatgactcaagtagtaatatttatctctttcaatggtgtagtatattaatagtatactcgggagagaaaatgatgtgataaaaatta

SEQ ID NO: 776 - DNA, 380 bp, Artificial Sequence
  Synthetic
ttggcagctcgccatttcttatcaaagagatacctaaatgataaacttaaaatacttgcagtgaatatatctgctagagtaagacgctctccaactaagaatgtgttgttttgaagagtatcctcaaaaatttgagcataatcgattgtttttttgacaccttcatcataaacctttttattgtatgcgacaataccaaaaaaaggataaagccagctggcatagcagttactaatatcttgattgacaaaagacatccactttaaaatagaggcataagtctaattatgaaagtccacacggagtgttaagacagggactgttttatgtcaaggaaaatttttcaactgagagagcttagcatactcctgcttggtttt

SEQ ID NO: 777 - DNA, 369 bp, Artificial Sequence
  Synthetic
gtctcatatcacgaacagcgaagcgacctaatggaggataacttgaaaatgactcaacacacataggtttagatggaatcattttaacaattgctgcgtcaccagatttaacaaattttggagttgcctcaatagactttccagtacgacgatcaattttttcaagaagttctgcaaatttgcaagcaatgtgagccgtatgacaatcaagtacaggtgcgtaaccagctccaatttgacctgggtggtttaacacgataacttgtgcggtaaaatgctcggcacccttaggggggtcattcttagaatcaccacaaacattaccacgacggatttctttcaccgaaacgttctttacattgaagccaa

SEQ ID NO: 778 - DNA, 395 bp, Artificial Sequence
  Synthetic
aaaacaaagccgaccttacgaaacaattaggagagcttaaaacagaactcggtcaattacggactcagaagattgctggaggttctgcttcaaagttaacgaaaattcacgacataagaaaatcaattgcaagagttctcacaataataaactcaaaacaacgttcacaacttcgattattttataaaggcaaaaaatacctacctcttgacctccgtccaaagcaaacacgagcgattcggagacgtcttacgaagcatgaaagttccaaaattttagacaaaacggccaaaaggctcacccacttcccccagagaaaatttgccattaaggctgaggtttagaatcaagataaggaatgatttatcttaatagagattaataaaaaaattata

SEQ ID NO: 779 - DNA, 386 bp, Artificial Sequence
  Synthetic
ggtgtggcatagctgcaatcattatttacattgattttcacagtttttcaattgagttcaataagatatatgaagacagagaatcatgccgaataaagattgctcgaacagtttcttgttgctaatatgttactctatttattttaacatagttgcgtatatgatcagtatatttactcaagacttaataagagtttagtttcacatttattgagcggttcgttttcctttcgcgttcttcttaggggtatcggcgatgactaaatttggaggtaacgattgctttaatttttcaactttctcagagtcttttaacacaagagtgtataagtatttctgacagcgaactttgaattttgtctgagaagattttttgtttcgtttga

SEQ ID NO: 780 - DNA, 398 bp, Artificial Sequence
  Synthetic
ctacagcagagcgtgtttcgaaggaatttccgaacattgagtttgatgcagaacttctcgataatacttgcttgaagattgttaccgatcccaccccctataatgacaaagtccttgttatgcctaatctatacggagatattctctctgacatgtgtgccggcttaattggtggacttggtctcactccttcagggaatattggcgacaaatgttcaattttcgaagctgttcatgggtcagcacctgatatagcgggtaaagcacttgcaaatcctactgctctcctactctcatccattatgatgttaagacatatggagctggaaagctacgcacaaaaaatcgagaaggctatatttaaaacccttgctgaaggtaaatcactaacgggtgat

SEQ ID NO: 781 - skipped

SEQ ID NO: 782 - DNA, 398 bp, Artificial Sequence
  Synthetic
ggaaaatgtgagttgccgccatcgataattatgtctccttgatcgaggaatggcaataatgtttcaataaaatcatcaacaggctttccagccatgacaagcagcataatacgacgtggtttttttagtttactcacaaattcctggatagaacgagcaccttcaatagatttcccttttgcctcattttcaagaaagtggtctaccttagctacagttcgattatatgcaataacattaaatccatggtctgcagcattcagaattagattctgccccatgacagctagaccgataaggccaaagtctcctgtagcagcactcatatttttttgattataaatttagaagcccaaagactggagcttatatggagaacagagattacacagatggga

SEQ ID NO: 783 - DNA, 388 bp, Artificial Sequence
  Synthetic
caacatggctgcatacggtgaagactcatcgcgatctgccttaactttcattcccccagttacacgagttatagtctcacgaccggagagatccgttatgtgtacaaatgtatcattgaagctggcaaatattcgtgccgttgcaaagacatttgattcaccttctcggagctgaggtccgagagatatattttcctgagcaggtcgagaagtctttttgggagccatgtatgttatgagttgctggtgcgaataagttgtacgtttcttaactgagaagacccgatatcaatatttcaatcattcaaccaccacaactattaattggcagtggtattttactactatcagatgtttctgatgagatggcctagaaattcatgaccca

SEQ ID NO: 784 - DNA, 393 bp, Artificial Sequence
  Synthetic
gtcgggtccataaatcataatgggactaagagcaggacaaatgctagacaactccacaaaaagcctataattcacataaccacaccagaattacttgcaatacgcggccatagttctgccgcctcctttcctacaggcccagttatagcagatcctttcatttctccctttggattgacaatcactcctgcgttgtcttcaaaatacaagaaaacaccatctgtacgtctccatggcttactttgtcgcacaattactgctggcataaccttcttgcggagatctggctttcccttttttaccgttgccattaccatatctcctacacctcctgctggtagacggtttaagcgcgcaccaattccttttactgagataatatacaaatttctt

SEQ ID NO: 785 - DNA, 398 bp, Artificial Sequence
  Synthetic
tagcaacgggacgtccactttgtactcttacagcttcacgtgtattatcaatcactgattgatggtactcatgagagccatgagaaaaattcatacggacaacattcagaccagctcttcgaagtccatttaaggcctcgacattgttagttttggggccaatagtacagataatcgaggttcgacgataattcttagaggtggcatactcagtgtcaagttgtgatagccattcaatgcgagtagagctggttaggtgattcatagctgaaaccatattttgatctaatgagaacttttatttgatgtgaacgtaaatagttgaggatgtgtaaagttgaggagagagttggccaaagatactctttgagggtagcaaatttcgtttatcttattat

SEQ ID NO: 786 - DNA, 397 bp, Artificial Sequence
  Synthetic
ttttaaagctatgtatcctcaagtaacagaattagaaaacctagttttcaaattgagattttggaaaaaatctaacaaccacttcacttggctccatcaattttggaaatataacttaggagatctaaaacacggcgagagtaaccccattcattatcataccatgatacgagtttgacaaagttgtcattgagcgagattccagctttcgcgtcgaaaatggatgagtgattatcaccgattaaatcagttgaaacgatgtcatcctcagtataagaaagtatgccttttaattcaccattggcagcctccttgatagcagccttaatttggtcataagtagcaccctttccaatgcggcatgttaagtcaacaacggaaacattagcagtgggta

SEQ ID NO: 787 - DNA, 250 bp, Artificial Sequence
  Synthetic
tcatcttttgccgctctttatcatgatcttgatatgggatttacaccgatcaactttacattttactgggcacctctaccttggaatcgtgctcgtgatcatgcccaaagaactgttgctaggacgaacctcgctccaagggggctttatgggaatctgcctcgtagtataaagttctgcagctggctctacggattgcatctacaacaactacaacatcatcatcatcatcatcttcatcttcatcttc

SEQ ID NO: 788 - skipped

SEQ ID NO: 789 - DNA, 354 bp, Artificial Sequence
  Synthetic
gagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctaggacttatatgaatataatccaagctcgtaccctcctcttccccttccccttcattgaacctcgctccaagggggctttatgggaatctgcctcgtagtataaagttctgcagctggctctacggattgcatctacaacaactacaacatcatcatcatcatcatcttcatcttcatcttctccaccttcataagcttctacgtttt

SEQ ID NO: 790 - DNA, 401 bp, Artificial Sequence
  Synthetic
atgccttacaaggagaagaggtccgtgagaattttgactcatcttttgccgctctttatcatgatcttgatatgggatttacaccgatcaactttacattttactgggcacctctaccttggaatcgtgctcgtgatcatgcccaaagaactgttgctaggacttatatgaatataatccaagctcgtagagaagagaaaacgtcaacaacccccctcctcttccccttccccttcattgaacctcgctccaagggggctttatgggaatctgcctcgtagtataaagttctgcagctggctctacggattgcatctacaacaactacaacatcatcatcatcatcatcttcatcttcatcttctccaccttcataagcttctacgtttttgcatgttcaa

SEQ ID NO: 791 - DNA, 398 bp, Artificial Sequence
  Synthetic
caccaggatccacctaaagatgagccaaccgatcagaagtctctggagctgaggagaaccttattttatagtatttactctcttgatagatctgtcagtatggttcacgcgcgctctttttcatttaccgacgattcgactagcgttactttcccatccattaagaacgagaaattaccagtcgacaccaaattaaaactaggtaggaaattcaagattcaatcctcacttttattcaaacttcgaaagattcagtcttcatggtatcacgagctttttcaatccaaaaatgattttataacaaatccatcaacatatattcagaaagtgtgtcaagaaatgcaagcatgggctcagtcgattcccgaatatttacccactcatatcaaaaattattt

SEQ ID NO: 792 - DNA, 388 bp, Artificial Sequence
  Synthetic
gtatcaaccattgcctctccaaacctttcaccaacaacttccttttcatcttttgtacgaacagaaacgcctgattccagtctgccatttatagaaaatccagtggctagacaaaatgcacattgtagtagtaagagtgttggcaatggaaatggaatttttaacttggacatgaatcttttggcttctgctgctattagggtggaagggaatcactcatcaaacgcttgtcatctcccccgatacaataaatcatgctgcgacctcagtgcgtacaagagtcgttctcattttgcctcatcatcacttgttcagtctcatccacctccgacattagacaagctcaatcattgcattaagaggtatatgaagcgttcacgaactgact

SEQ ID NO: 793 - DNA, 327 bp, Artificial Sequence
  Synthetic
caacagggaccagttaccctacacctactggaggttactctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatgttgtgtacattcatagactgaatttcttttttattattt

SEQ ID NO: 794 - DNA, 250 bp, Artificial Sequence
  Synthetic
tctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatg

SEQ ID NO: 795 - DNA, 300 bp, Artificial Sequence
  Synthetic
ttaccctacacctactggaggttactctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatgttgtgtacattcatagactgaattt

SEQ ID NO: 796 - DNA, 350 bp, Artificial Sequence
  Synthetic
gttacgcatcgccaacagggaccagttaccctacacctactggaggttactctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatgttgtgtacattcatagactgaatttcttttttattatttttttccaaata

SEQ ID NO: 797 - DNA, 398 bp, Artificial Sequence
  Synthetic
attgatccagaatcaggaagaaatgttaaaatcaggacgtttggataaaaaatatgatggaattttagattgctttaagcgagttacggcaaatgaaggtgttgcttcgctatggcgtgggaacacagccaatgtgatccgatattttcctacccaagctttgaatttcgctttccgagacacttacaaatcaatgttcaatttcaaaaaggaccgtgatggatatgcgaagtggatggctggtaatcttgcctctggtggagctgccggtgctacttctcttctttttgtctactcattagattatgctcgtactagattagcaaatgataacaaaagcgcgaaatcgggaggtgagcgccaattcaacggtttagtggatgtatacaaaaagacac

SEQ ID NO: 798 - DNA, 398 bp, Artificial Sequence
  Synthetic
aagacggatggctaaagagatcttaatttatcgtcccgttgctgtgatatagactattctgattgatttacttctcgtcagatatatgccttttataatttattgcttcggaaatcttgagaggtaatagacgcgattgaggggaggttcttttacatagtgaatatgtcaagaaaaagaatagatcaagaatttattccttctttgctttttaatatttttggggtttgttttaactcctttttctttagatattaattatggcttttctagtaatttttctgcatcgacgaaaaatgattggagatgagaaagggaagtagaaagatgcgaagtgctgtaagttcgtattctgggtagagtggaaatgcgaaagcaggcaatgaatttattaaata

SEQ ID NO: 799-801 - skipped (3 entries)

SEQ ID NO: 802 - DNA, 398 bp, Artificial Sequence
  Synthetic
cgtcgacctcaaaagcagagaagttgggcgagttgattattgcttctacggagaaagcctgtataactgtaggttcgtagctttgagcattcaaaaatttgttgtaaacgattttagtagatgagtattcacttggcaaatgagagatttgatctgctattgtttgagcgtctgcaaaggttggaatatctttccctacgccagagaaacttaaaacaatatttttactacttgaccgactcaattgtgccttagccttctctcccaataccacaatatcggcattggggttttcagagagcatttttcgaacgtgtttacttaagcctgaatgaataccgccgcacaatcctttatctgagcttgcaactacaatcaagtacttttggtcatctttt

SEQ ID NO: 803 - DNA, 398 bp, Artificial Sequence
  Synthetic
cttctcggtaattccgcaacatttttaaccatgacattccatttcgtacatgctcttgatattccgataacgtcagcctcttgaaatgcatcacttcctatggcagtagtgggcacttggccgcaaaaaactactagtggtgtaccgtcagatagagcgtcctgcatcggtgttatgacatttgttgcaccagggccagaagtaactagaatcaccccaggaagtccactagctctggcatagccttcagccatatgtccagcaccctgttcatgtttcggtagaataaaatcgaagtgccttgaattataaatagcgtcgaaaacgggaagaattgctccaccaggataaccgaaaatatgttttacaccttgccgtaacatcatttcgtgaaatat

SEQ ID NO: 804 - DNA, 398 bp, Artificial Sequence
  Synthetic
ctgctggtagtgacaagggcacagaacacgtctgggaaataagccagagcgtgggcatgataattggtggaattttagaaaatttgctcatgcttatgggaaaagttcccagcttaacgaggaggcaagtacgatatagctgtatgacaagatactatgactgtagtaaagctaagaggctacttggatatacaccagaagtccacctgtgggaaggcatagagaggtcagttgcttggttcaaaaatcagagttaattatcgaagcccgaatgaatacttcatattactaaacttgcccgaattaaaattctggctagcttagttatcaaataaaaattgatagttaagttgatctttcattgatgaatatataagtacttaaccttatcattcaat

SEQ ID NO: 805 - DNA, 398 bp, Artificial Sequence
  Synthetic
atcgtgaatggagctgtaactgaaacaacagctttactaaacgaaaaatgggacaaaatattttacactggcaatacccaagtaggtgtaataattgccaaaaaagctgcagaaactcttacaccagtttgcttagagctcgggggaatcaatccggcaatcattacgaaaaatgcagacccataccttgctgctcgtcggctattatggggtaaactaatgaatgctggacaagtttgcatcagtcaaaattatattcttgtcgaacaagaagttttaccaattttcgtagagcatttgaaaaacactctaaatgaattctatccaaatggtataagaaatagtccagattttggaaggatagtcaatcagcgtcatttttctagaattaaaaaaat

SEQ ID NO: 806 - DNA, 397 bp, Artificial Sequence
  Synthetic
cgaggttcatggtagttccctatctaaggatgatcttcgagatttgagaaatattgacctctcagacttttcctaccgacagccctatatgcaagaaagaagagacgccgttggccaaagaggaaacataagtaatagaggaagaggaagggtgagaggtataggaagggatccaaacgtggaccttccccaacccttaagtagtcaacctttaaggagggacgaacaagcatttcaaaggcaactagcagtccaatcctctcagtctgtcacgacaaggaactccgtccatcaaaatacaacaccagcatcgcaaatatcaaataatactccaaaatcacagtctcaagtaacaagatccccccagacttctaataaccttgaaagtgcaaacatt

SEQ ID NO: 807-808 - skipped (2 entries)

SEQ ID NO: 809 - DNA, 374 bp, Artificial Sequence
  Synthetic
caggactgtccagttagatctagagtcaaaatgcccaaatcatccaaaaagtaaggtggtataagaagaagcttaacgtttatagacgtaactgaatctcggaagaacagctctttcctagcaagcaagtagttgtgaaattacctgctcctaggtttattttttattttcaggtggaatattgatgatcgctggatccacaaaatgtaaattaaaaaaataaaaacaaatatctggtgactgaaggatttcatgtagtgactaaacgtcagtacaagtcacagagtactgatcaaaactacagaattatatctcgacgtcttccctgaagatgataaaagattcacccacaacataaagctttcattatatat

SEQ ID NO: 810 - skipped

SEQ ID NO: 811 - DNA, 384 bp, Artificial Sequence
  Synthetic
gtgttgagacctaagagcctatgagtgagtcacattacaacagaaagcctcaagtctaaagtcataacctattaaaattcgaaagcacaaaaacatccattaggaactgactaagtacaagagctactccataaaaatcagtcgcaatacatgtttttgcaaagcagatcaacctggttaagacgagaaataacttagtattcaacgtagctaaatctccagggtgttagtgtagtatattgacgtttccgaaataattaaaaccagcatcttagtttggtgttatttgatatatatgataagattcgtttaggatttattggaatttatttggctggtatctaatgtagatttgattgataccgtattatcaaatcattttat

SEQ ID NO: 812 - DNA, 392 bp, Artificial Sequence
  Synthetic
ttatcatgctgccatggttcataagaaaaaaatttactaagattagtagggatgcatagacctaatgacacgcccataaaagttgtatggctatcccaaccatgttcagaaagtatctcgagaccatgaatgcttctagaaataaggccaagtacgaaaaatgcggttcctctcatgctcattatttcatgcgattctgcaattttaattatgttctgcacgacatctgatttttcaagaaaaggagcacccaattccatagatccaacgttacctacagcccataggcatcctttaaccttaagaataatctctaaatcatcataatgcattccatattcacgaatggttgaggcaaattcatcaaaatgacctttatcatgcaagagctt

SEQ ID NO: 813 - DNA, 394 bp, Artificial Sequence
  Synthetic
ttgcaatatctagtaaaactcttttaagtcgaatagataagaagtattggctctatttgaaaagtgatcgaaatcaagatgaaaagctgagattcctcatgactttagataaagaattacctaaacatcttctttgtttctcctgtgcaatatatcattgtcggcttaatattggaaaagaacgccttaaatatgcatgggtcccgaatcctgtctacaattgcaatggatctaaaaaatttgggctgcagcagcccaagattagattaacacacggtcattttcttccttttgcatttgtacagcttgcaaccagagccgaaaagtacactattcaacacggtatcccattaattaatttgtgtcgtcgttacaaagaccgtaataccgattg

SEQ ID NO: 814 - DNA, 344 bp, Artificial Sequence
  Synthetic
ttggacaagggatcgactgctaagcaagcatcaagaacagcatctgaaacctgatcagctatcttatcaggatgtccttctcccacagattcggaagtgaaaagaaaagttccagagttttgagccggcatagctgcaatagggcaaaaatttaagtctaattagtgtatgaaaagtgaggagacgccttgaagaaaaatatattctgtaaaagacttgaaaatgaaagtcgagatttgaatgaggggtaaagcagaaactagagctatttagctgccttgaggaataaaaactaagcggagatgctctaaaaataggcagaacgatatttgtggactggccat

SEQ ID NO: 815 - DNA, 398 bp, Artificial Sequence
  Synthetic
aggcgtggactgtagcctcaatagcatacactgaatcgaatgagttgtcaggaaatgacatttgcataaagtcacccttaacaaagcttaattggtttgataagccttctttctgtgcatatctcgtggcccgctctatttggtaatcattgttgttcaagccagtaatatgagcgccagtaaacttggcgatttctcttgccggaccaccaacaccacatccgacatcaagtactttgtctgcctcattaatgcctatcttagcggcaagataatgttcatgtcgcgcaatcgcttggtaaaatggttcaccgtaagcaaatctacagaagtgaaaagattgtccccagccgtattcgtaaagatcggtgccgagattatagtactgtcttgtcaaa

SEQ ID NO: 816 - DNA, 396 bp, Artificial Sequence
  Synthetic
caaactcgctcaattctccgtatgactaattgttcttatacttatcctggcgcttcaaaaccgtctttgcacaatgtgtcttgtcaactctccctttcatctcgaactgcaatcataggtggtaatggtgcaggaaaatcaacgttaataaaactacttactggcgagacggtccctacttctgggcgagtcgaaaaacaccctaatttgcgaattggatatataaaacaacatgcacttgaacatgttgaaatgcatctcgagaaaaccccaaaccaatatcttcaatggcgctatgccaatggtgatgatcgtgaggtacatatgaaacagactcgtattttatcggatgctgataaagctcaaatggaaaaatggattgatatcgatgggaag

SEQ ID NO: 817 - DNA, 398 bp, Artificial Sequence
  Synthetic
cgctccaaaatcgtcctacaaaaaatcttgaagaaaaaattacaccagttttacctaagattattagtgaacattggaagtctgactcaaatcatcccgcatcaccttcacaattctccaacatgacttacgaagaaaaggaacgagaacgaaatgtttgtagtgcagcaaaggacttagaacgacctccatctatcaatgagccatcctcagattataaccgtgtgcgatctagtgaaagacaaggagttctccgacaattctttggtgctagacccccaagtgaattaattacatcagatttaaccacatatttccctgatcatcctagagaagaaattgaccgaactgctcgactttcaatacggagatcaactcgcctcagtaaagttaatagt

SEQ ID NO: 818 - DNA, 386 bp, Artificial Sequence
  Synthetic
ttcgctgtaaccctcctagtatttatttctgcccaagttttcttccgaaaaatctaaaatctgagagattttttctttaattacgaaaaccagagttaggatttaatgattttaaagatatcaacatctcactttaatcccctctcttccaaatgccctgactcaaccaaaatgttaaccattaaaatcaaaatcaaaaattcaagcccaaatttagtatccgtaaagaaatgaaagttaaatgaattgaactgaacaaaaatttttggaatattaatacgccaacttatataaaagcgtaattaagagaatttttgccggacactcatattttgatgttctgtttaactagtattgcaacactgttgtttctcttaagccactta

SEQ ID NO: 819 - skipped

SEQ ID NO: 820 - DNA, 398 bp, Artificial Sequence
  Synthetic
tcagtgagagtgtttcgtagagaataggcataggattctaatccattcttagcagtaatcctgcctgcttcagcttcatcatcagccttatatttttcagcttcggacaacattctctcaatatcctccttggaaagacgtcctttatcgtttgtaatgacaatcttgttagattttccagttcccttttcaagggctgatacattcataattccgtttgcatccaagtcaaatgtaacctctatttgaggtacaccacgtggggcaggtggaattccagttaactcaaatttaccaagtagattgttgtcttttgttcgttgtcgctcaccctcaaaaacttgaatgagaacaccaggttgattgtcagagtaagttgaaaatacttcagacttctt

SEQ ID NO: 821-822 - skipped (2 entries)

SEQ ID NO: 823 - DNA, 357 bp, Artificial Sequence
  Synthetic
ctacttgttccagtaacgcttttctatcttattttacgaggtctagacacaatcgaagatgatatgacaataccaattgaaaaaaaggagccattactaaggaacttccatgatgtaattgggaaaaaagaatggaattttgatgggaacgggcccttagaaaaggatagagaacttcttgttcactttgatgttgttacaatcgaattcgcattgatcaaacctgtataccaaaccattattaaggacattacagagaaaatgggaaatggaatggctgattatgctttaaattcagagcaaaatgccaacggtataaatacaatcaaagactatgaactatattgtcattatgtt

SEQ ID NO: 824 - skipped

SEQ ID NO: 825 - DNA, 398 bp, Artificial Sequence
  Synthetic
ataaaagactaatatgatctaatttaaatcgaactgattgaaaaacatttgatttgcaatgaaaattaatatataatcaaataaaatcaaatatttctcactctggtgccggcccgttgtggtaggaagtgacccaactcttaaatcaggtcagcaacattcataggcatctcttcaatttgagtgctataaaactgctcaatttcacgcatcatccgaacatcatcagctgttacaaagttgatcgcaacaccttttcgtccaaatcgaccacctcgaccaattctgtgaatataattctcacgattagcaggcaagtcgtaattaataactaatgaaacttgttgtacatcaataccacgagcaagaagatcagtggcaattaaaacacgggatga

SEQ ID NO: 826 - DNA, 398 bp, Artificial Sequence
  Synthetic
tatctgcatgtgctagatatatgatttttgcagcttcattgactccgtcaagtagacttagtgtgccagatgcaagatccaacttttccaactcagccttggcagtttgtcgtcctttaccagtagcagcaccatagtaaccccaatatgatccacttggctcaatcataaatagtcctggaccaccataggtcttaccctcagcttttccgcctgagccaatctctggaccacttccaacttcgctatcaacaggaatttcagattctgagtcccatccagcgattatagctgtgataccaaacggcctaacagaagagtaaagggtgtacaattgcaagtattgacccattcgattagctaaatcagcagtagagatgggacttttatagatttgt

SEQ ID NO: 827 - DNA, 398 bp, Artificial Sequence
  Synthetic
ttgagtacagagtagtagtaatctatttacatgaattacaagcttgtacggatgaatgtttgtcataagcctactcatctttcatggcgaatttcccaggcggctaactactctaatttgtgagaggcatgaaagtaatgatagattttctctatgtataataaatagtactcgtattttaatcattcaaaccctagtgatatcttttgtactcttctcttatcaaattacatcaagttcattccgtcatttctcgttatatatgacatataaagcattccattcgcatgatagaaaataagtaatatgtataatgactcaaagccttcaccccatagccaaaaagttgggtttatagtgaaacttgtgacgtagaggggattaatatcgcattttct

SEQ ID NO: 828 - DNA, 398 bp, Artificial Sequence
  Synthetic
aatgatgtaagctccatgggaattcataacctgagtgagcatcaatagcttggaatagtcgacagataatccaacaatacatcgtaactaagtgaagattgccagttatcagacaccatacagttggcattaagactgttcctgcgccaagaaccattgtttctattggtgaagcatattcagctgctagtccgaagggtgcagagtaatgatgatgtattttatgaatatgtttgtagaaaggaccccaatgaaataatcgatgcatccaataatgccacgtatcttccaacacgaaaaagaaagcaatctgaagacacatagtttttaatgatggaaatgggacaccaacatccataccacaagcctttgtcaatggatgaaaaagccaaatttga

SEQ ID NO: 829 - DNA, 396 bp, Artificial Sequence
  Synthetic
tttattatggcactggcgtgaaaataccttatcccaaggcagataccgataatgcgagtgctcatggatatacaaacattaagggcggtaatccggaaggacgagcttttcaccatggtagactaatatctcagctccgtagatgctgctcccagaacccgaacatcaaaattgttgaaacgctggttacagagactattacgaatcctcaaacccaaactgtaattggcgtaaggtcagagacaatgaatgataaaacaggcaaaagagaagccgactactatttgggagatctcacaattatcgccgatggatatgcatctaaattccgaaagcagtatatagacaagtcacccatcgtaaaaagcaaattctatgctttagagctgatagatt

SEQ ID NO: 830 - DNA, 397 bp, Artificial Sequence
  Synthetic
tgtcaagcgtataacagttgacgaggctttacaacacccatatttagaaccatatcatgatccagaagatgaaccaacagcccagccaattccagaagaattcttcaactttgacaaaaataaagataatttgactaaggaacaacttaaagaacttatatatcaggaaatcatgcgatagtaggatatttaaaatttgaacgagacacaaaagacagcccgagttggtaacaatattcttaacaactcttttattaccagagaaagttgaaggagtcatatttaataagttttaagcacatggctggccagattcatgtctttagaaattgattcgagaagctaaaatttaccggttattagttcggctagagttggatatatttatcaatatata

SEQ ID NO: 831 - DNA, 397 bp, Artificial Sequence
  Synthetic
attcttgtcatctcagggtcaaaaaaggatgttagctcaacatcaggtatgcaagctaccacaaaaacatcagagctttttaatcgacgtgtggaaactgtcgtgccagcaaatatcaaaatgatgcaaagcgcaattatgaacaaggactttgaaacctttgctaaagtcaccatgtcagatagcaataattttcatgcaacttgtcttgatacttacccaccaatattttatatgaacgatatttcccgcgcgacgataagattagttgaatatttgaattgcattttgaaccgtacagttgcggcctatacttttgatgcaggtccaaacgctgtaatatattaccaagaggaagacgagaaattagtcgttggacatgtaaaaggaatcctag

SEQ ID NO: 832 - DNA, 394 bp, Artificial Sequence
  Synthetic
gtccgattaaagtatctctctacatttgagaattctacagacctaacttgggagaatactgatatacttgtatggtctattctcgaaatcgaagttactgtcatttgcgcatgcttacctacattacgtccactctttgttgaaataattcctggagtcttccgaacagctaagaatacatcatcaagtagcagaattactaatagtaatagtatattgaaacctaaattaactaaattcacatttaacttgaatccccggaactggctcaggtggaagaataaacacaagacagaatcggaaaaattgccagtctgcgaaaaatcatggagttcggtgccgggttaaacatgggagtaactttgatcagatcataacactaattggatatttt

SEQ ID NO: 833 - DNA, 398 bp, Artificial Sequence
  Synthetic
ctagcacttacgagcacgtctctttgaattcaactagagactcacaattataccttcctcctattaaatctttagtattggatacgaaaaatgagggaagttattagtgttaatgttggccaagctgggtgccaaatagcaaactcttgctgggagctctattgccttgagcatggtatacagcctgatggttacttaacggagaagcgcaaggccgccgaacctgacgaaggtttcagcacttttttttcagagactggtcagggaaaatacgtacctagaactatttattgtgatcttgaaccaaatgtagtcgatgaagttcgtacgggtacttatcgtagcttattccaccccgagcaaatgatcaccggaaaagaagatgcatcaaacaatta

SEQ ID NO: 834 - DNA, 398 bp, Artificial Sequence
  Synthetic
gactattgtcctgactaaactatataccatctgctaacacgatcctcaaagcaaaatttttaaccgatgatcataagtcatgtaaaagttgaaatttcaacacacaccaagaaaaatagccttggtctttcaatttacagcatccatatggatgctattttcttatatatttcacctacctcctgagaactgcatcaagattcgaggtcgtttctttatataatcatgtcaaataatgcatgataaatgagtaagaggctctaggcagtcaaactcaaagaattgtcttcaattgtattgtcattttatctcatttgataatgagttgtagccgcaactcaaatcatttttcattttttgaaaatgaagtaaaagaccggtttaaaaaattaaatatc

SEQ ID NO: 835 - DNA, 396 bp, Artificial Sequence
  Synthetic
gacacaggaactcagcacacaaccgttgagcaagatagtgtccgattcgtttatcaacctcttgacgagctttacatggtacttgttactaatcgtcaatctaatatccttcaggatattgataccctccacgtgttcgtacaagttatcacaagtatctgtaagtctctagaggagagagaaatactgaaaaatgcgtacgagcttttaagtgcatttgacgagattgtctctcagggttatcgtgagaatctaacaatcaaccaaattaaatcttttttggaaatggaaagccacgaggaaaggatacaagaaataatatcaaggaataaagagctagaggctaccgaagaacgaaagagaaaagctaagcaattggaaattcaacggaaagag

SEQ ID NO: 836 - DNA, 388 bp, Artificial Sequence
  Synthetic
gtagagttgagcttggccctaatggcgtaaataagatccatgaagtgggaaaccttgctcctgaagaacaaggtcttttaaaagctgctctagttgatttgttaaagaatatcgaaaaaggaatcaaatttgttaaccagaaccccggtgaataaataaaatgttattcaatttacaatctgttgttttttgatcgtggataccttgatattcagtaacgagggagaatcattctcctgtcccaaaaaagtactatctactatcttaaattttatggaatcttgaatttgtccaatgtatcaatagaaaaattctttcaaattacaagtcaaaagtattatgaaaattaaaaaggactaatcctcttacatagatatatataaatata

SEQ ID NO: 837 - DNA, 398 bp, Artificial Sequence
  Synthetic
gtgagtatcaggtgtataaataaaacgtataaaaatgtgatgttatagatcgacggtcaaagatttctagagattgaggtactggacattccttcttcaacccctcaagaaattgttaagtcgaaagattagtaattctcaactctgattaaaataatcgatatgtatgaagataagcgagatgaattgataatgttgtctaaaatttcgaattatgaatctttacaaaagagggtgagttgtcgtatgataaaaggagcctgctccgatctagatagaacacagcaggtaaagtagaagtgatatctgcgaggagccttgacaccagcaaggactcagtccgaagagtacgagttgctttctggtttgttgaatgaaagaagtagaaaaaaatataa

SEQ ID NO: 838 - DNA, 357 bp, Artificial Sequence
  Synthetic
aagaaacagacagatgattttatcatatttcaaggtatatttgaatttagtgaatctagtttaatataatttaaatttattcgattatcaccaacctatgaaaaaatcatttcatcccaattccgacatgaatttgtagtgtctgacaggtttgtttaaaaacgaagtggtgtaaagaaccatcgattctttccacttaaatatctctcctctaaggctttcttaaccactttcttggcatcctctcgctgcgatacttccttgaatgtttctgtagatattacgtttttaagaccttctaattcgagtgtgtaacgtgttggcataatatgattataattgataacttttataaaa

SEQ ID NO: 839 - DNA, 398 bp, Artificial Sequence
  Synthetic
tgtagaggtgaagtaggtgaaagttgatttggcgatggtagagatgagttactattactgatagaaggtaaatttgagtaagattgcaaatttctatcagacgcagctgactgatcaagagtttgctctaataaggatctttcatgagctgaatgcgcatatgtcggtgacaaatttttgggatgatcgataaagaattttttggttgaatagttgcgagagattccaggttgtattgcaggtgatgaagaagctggtgaagaaatgttgcttgagttgtcaaaattgctactgtttgaaccatttgtttttgcggaaggatacgggagtggtttaccttcttttgccatccgaaaaactggaagtaaatcctctctaagtcgtgtatattcgaatgt

SEQ ID NO: 840 - DNA, 387 bp, Artificial Sequence
  Synthetic
cttcgcaggctgattgtgctattttaatcatcgctgctggtaacggtgaatttgaagctggtatttctaaggatggccagacacgagaacatgcactcctcgcattcacacttggtgttaagcagctcattgttgcgatcaacaaaatggacaccgctaaatgggctgaagatcgtttcaaagaaattatcaaggaaactacaaattttattaagaaagttggatataacccaaaatcggttgcttttgtaccaatttctggcttcaacggtgacaatatgattgaaccttcatcaaactgcccatggtacaaaggttggtcaaaggaaacaaaagctggcagtagtactggaaagacacttctcgaagccattgactctatcgacc

SEQ ID NO: 841 - DNA, 398 bp, Artificial Sequence
  Synthetic
tccatattttcaagacactcaagttaatagcatagaaaatggtgctagcctttttaacaaagccttggtagatacgaaaaatgcagtcggggctaagcctgtatggatcacagaaacgggctggccagtgagcgggaaaaaatcaggctatgcagaaacaggagccacaaatgctaagacttattggaaccaagtaggatgtcctattttcggggccgtcaacacttggtggtttactctcgatgatacagataacagctaccctaatcccagttttggtattgtctctggcacaaaacccctatttgatcttagttgctctaaatctggatctggaactatctccagcgttaatactgcttcaataccagaaccaacgggagcagttgtatctagtg

SEQ ID NO: 842 - DNA, 397 bp, Artificial Sequence
  Synthetic
aactcaaaaaagattgtcgggaagtctttcctaacgtagaatatgcatatacgacaataccaacatatccttctggccaaatcgggtttctagtttgcagcaaagatcccgaacaagacctcaaggtacccctaagatcttttagtgctgaagaagaagagaagctgcttcgctactataacgctgatattcacaaagcaagtttcattttaccaacatttgctcgcactgcactgaagtaaggaaaacgggaattcctaagtaaagttacaacataattatcttccaaaatctttaggatatgaaaatctcaagatgaaaatgttatttactactttgataatattggcagatgataaaacgttattggacttgaaggattttttaacaagttttg

SEQ ID NO: 843 - DNA, 350 bp, Artificial Sequence
  Synthetic
ctgggtgagtttttcgtaacgtcgctactttattaacttgatctgccgtggattttggttgtcttgtatcaatcaaaaggagaggaagcttcggaaacttcattaaagatcttatgattggctcctttgaatagtcgggcctctgaaatataacagcttttccttgggaggcaacagtgttatctactcctgaagggtttccatggatacatatttctcctacataagcccacatattaatgcggcttatttgggtatgtgcttcttcaatgggttggtcctcatgaggcccagaaagcgctcttacctgtaataagagcgcagcagctagacacacagtaatagatgca

SEQ ID NO: 844 - DNA, 391 bp, Artificial Sequence
  Synthetic
gatctggtcgtggtttgccgaaaagattcttcattcctcccgttataagaacggtgagtgatagtgaaaagcttaatccaagcaatccaacgtgtaattcccacattctccgatgccatatggcagatctaggcgttgactttgtaaccgtcggtccaggaacaagaactaagcaaatagcaaaaataactaatgccggaattataaaagcatataatccaagccatcgtaccgagactttttcatgtgttttatagggaaagctgatatctgggttctccagcgagaagggtcttttgtttggtaccctcgatccaacaaataatccaaaaaatgcaccaaatataactaccagccaatcgacaacatatgaaagtactagttttaatga

SEQ ID NO: 845 - DNA, 394 bp, Artificial Sequence
  Synthetic
ttggtactatggccagggtcaattcaattcaatttttttctatcaaataaaattaaatcaaaatagttttcaatccaatctaacccaatcttaatcttaaaatgtaacttcaaacattgtgattcaagtactaatcacacgagaaactagcaacgtttgatctcgcttttcgatctactttaggtacttgatgaaattttcaaagatattttgtcataaaaccagtcactaagcttctttgctatataattgcactacgcgacgtcaacagatgctcttttcacactcctagttattaaagcaattgaaacatcttctaactatatacaacttgaatataactccagatttgaatatattctccaccaaaatttaattaggtttgcaataaatt

SEQ ID NO: 846 - DNA, 398 bp, Artificial Sequence
  Synthetic
ttgagaacatgaccgaggctactctaatcttagatatgtttctcaacaacgagggagcctttaactatcctcacatttcctttcgcaaaaatttccaccctttcaacttctctaaaaacaattgatttgcttagaccataagaatatttcaatatgattaaaactgaagctaatggtgaaggatttgatatttctattccagaggtatcagtaactgaggaacgaaagccatttgtgcaaaaggaaggatatctcaaattaaagcaagcaggaactgcaagagcgaatgaagccgcttcatacgaagctccacgtggcactgtaaaaggagattacgcataccgtcatcgacatcagacagtactccaacagcatatagccttttttgatcatgataa

SEQ ID NO: 847 - DNA, 313 bp, Artificial Sequence
  Synthetic
cagtgctctcgcagcaggccatttagtcaagagccatatggcacataacagaagtgctcctattacaagaagtaatacacctgctcagattagcacacacccatcaatgatatcaacaaatagcatgagagaaaaatattgagatttgaaattctaattgtgtaaatgagctcagctatattgaaaataaattggtaatctaatatagaggtagaactagttcgatttttatactcattaaaaaaaggaactaatattggtaaagggttaagctatgaaattagctatccttttttttcctatttattgaaaa

SEQ ID NO: 848 - DNA, 396 bp, Artificial Sequence
  Synthetic
aataagtgtctggattgttgaatgggattctttttagtcgatcaatttcaattaactcataacgcagaaatttcttaaaattgaacgatttataggaaccgatgtgaaattttcttcaatctccatgtcaatcgcagatgtgggcaaaaaagattgggaagagaattcttagttatatttcatttgaatactattggggtaatgcatgtccaaagagtctcgtaccaagagatacctttatctggaaataattagaagatttacccgtcttaccttgatgaattgtgtgttagagatacaccatggctaagatattaatatctatttagtttgggaagttgatgacgatacatcacagttctctgtaaattttgttatttcctctaatatcattaa

SEQ ID NO: 849 - DNA, 400 bp, Artificial Sequence
  Synthetic
tacccgtctgcaacaggtacaggtggttacgcatcgccaacagggaccagttaccctacacctactggaggttactctgaagagccctaccactataaaggtgtcaagctaggtcattgagaggattgagttacgaaatttgattgcagccacgccttcgacttcaaccgagaagagttccaatctccctcttagacgcaggactactctcacgatacttctgtctctacttcttctcatgagcacgctaatactctctaagcctccgttgatgtgttgaaagacaggcacctcagttttgattctattcagctcggcaaacatgttgtgtacattcatagactgaatttcttttttattatttttttccaaatacactcttcctggaaaaagaagccct

SEQ ID NO: 850 - DNA, 398 bp, Artificial Sequence
  Synthetic
gaagaccaagctagagcgagtacaaaaacatcccgcaacatatcaatgtcatctttgccccaaaaaatttactcgcgcctataatcttcgctcccatctccgaacgcatacaaacgagcgaccttttatctgttccaagtgcacaaaagcttttgcgcgtcagcatgatcgaaaacgacatgagagcctacattcaggtgaaaaaagatttatttgtagaggagaacttaaaaatggtggtcattggggctgtggccgtccctttgctcgtgcagatgccttaaatcgacatttccgatcggaagcaggccgagcttgcataaatccactcatagaggaagacgaatctgaaaatctacggctatggaatgagaaacaaattcaaaatattaaacaaa

SEQ ID NO: 851 - DNA, 380 bp, Artificial Sequence
  Synthetic
acccgcaggtactcttatgcttggagctgaaggtattaaagatgccataactggcttcgaagatgctcgtaaagtagatttaaagaatgaaagattgcctccaagtcttgaggaaattacacgaacaagtgaagaggatagagctctggcattagagagggctaaggaaagtgcggataatgatcgagggcttcagattttatctagaagactcagtttagttggcactcaaccaaatagaccgcaaccgagtaaaattctgaactctgttctagccctcgataaagatgtttctgagaaataagaggtcgatcagagtcacctcctgttacaagctcattggttggtctgcaggtacagaattactaatcataccacga

SEQ ID NO: 852 - DNA, 397 bp, Artificial Sequence
  Synthetic
caacagcttgaattgcacggaattatcactatcatcccgactaagcctctcaaaaagcaaaatttatttgctagctcggaaaagataacagctagctacgcaaaagctattcaagatggttgttggcattcattttcgccaaactctcagaaaagctgcaacaaatccccgtcatatagaaaacaactctaatcagccagaaactatgttgtccggagaaaatattgggttacttacggggcgaacatcaaacgcccgcaaaagtgcgtggcgacaaatttacgatgtactcggaagcaaacattattcagccggaaaagatagtgatagtaaaattgtacgagctatagcgccaactattcagattacaaaaattacgttatacagtaattatgtc

SEQ ID NO: 853 - DNA, 390 bp, Artificial Sequence
  Synthetic
gaagatacaaatttatgcgctattcatgctaaacgtgttactataatgcaaaaagacattcagcttgcaaggcgaatcagaggggtttggggtggtttaggctagcttttttattctaaatataccagtgcccgaatttgatctccctaagccacaccatcgagttgaaatgatgagaggaagatgacgagaataaaattattgtgaatattcgttatatggataagcgtagaggggatctaatacttgtgaattggtaatcttgagttatcactttttctggcgcatccagcgaccctaagcatatggacactagtgattgcgtcttagggttatagtagccaagaggaatttgaagcacacatattagcacagcataataataaataa

SEQ ID NO: 854 - DNA, 393 bp, Artificial Sequence
  Synthetic
tccggtgccatttcccctggtgaaatcacctccttgcaacatgaattgaggaataatacgatggaaagcagagcccttgtatccaaaccccttttcaccagtacagagagcacggaaattttcaacagtaagcggaacatcttgctgaaatagattgaatttgatagtcccagattgtttttcaatcttagcagttggtcgaccagcctggtcgagaactggtccctcccaattaactttgaagaacgttttgaccgacatatttgttgttgaacagtggaaatttctgacaggaaatgaaaatttaattttggatggtaacatgaatgagaactggcggggtatcattttgaagttgagaatacgctagctcggaataggcaagcgagatga

SEQ ID NO: 855 - DNA, 391 bp, Artificial Sequence
  Synthetic
ttctacacttggcattttccttacaattgcgttctgctttgccattctatgaactccaagtgctaaagttacagttacaattataggtaagccttctggaatagcagcaactgctaaagatatagaaacagtaaacacttctaaaaggccttttccttgaaaccatccaatcatagaaataatagcaattatcaaaaaagatgcttggcttaaatgtgatccaagggagtccatggaaagctgaaggggtgttctagggctttctgtctttgttacagctgcagctattgaaccaaagtgagtattttcaccagtcgcatacacaataccttgcccatagccagaccgcactaatgttcccataaaagcaatatttgttaaattacttgaa

SEQ ID NO: 856 - DNA, 396 bp, Artificial Sequence
  Synthetic
tcagtgagcttctcaccgatagaagtcattacatagcggagttcagcagcagagataaagccattattatcacgatcaaagaccttgaatgcctctcgtatttcttcctctgaatctgtgtctttcatttttcgagccatcatagtgagaaattctggaaaatcaatggtaccattattgtcagcgtcaacctcatttatcatatcctgaagttctgactcggatggattctgtccaagggatcgcataacagtccctagttcttttgtagttatttgtccatctccatctttatcaaataaagaaaaggcttctttgaactcagatacctgctcttctgtaagagaatcagccataattgcaagaaattgaacaagataagaatttaagcgtgat

SEQ ID NO: 857 - RNA, 377 nt, Artificial Sequence
  Synthetic
ucaugggugggaaaauaggcuagaggaugcuccuaacaagcaagugguggcugaagaucuugcaaaagcauugaaaaauauacgcgacggaaauaaaagcugcuucccagauagucccauuagugaucguggggaaacuggauaucgaacucgaaguacaaguuguacaacuauuuauaggcccgaggaacauggugguagcccaaacuuaccugcgauaaauguagaggauacaacaggugauaauugugaaccaauucccauggagcacgaaaagccuaucuaugcacauacgaguagaccuccacuagaguugauggauguuugccuuuguugauuuuuuuugcuauggauuuuuauuauucugcuagaaauau

SEQ ID NO: 858 - RNA, 383 nt, Artificial Sequence
  Synthetic
ugaaugguggcugccacgucaaauauaugcucgauugaaugaaaugguuuugacaguucuuuauuuaccucuacuccuaguugcggcuugguuugaaacaugcagugcgaacaaaguuacagcuaaucggagccgaggugaagaugaugaugauacucuccaagaaugggaacaguuaauggcugaaaacgauuuuaauacugauggcugggauaaaagaguucaaugugugaagacaaauauugaagaggaucaaacuaauguagagauuuuaaaauugauacacgaaguugaagaacuuaagagccuacugaaauuaaauuuagaaaagauagcguaauaacuaugauaaacaauuccauauauuuguuaaagcuuauaaa

SEQ ID NO: 859 - RNA, 398 nt, Artificial Sequence
  Synthetic
gcucuucucaauggaucccaagaugaucuaaauagaaucgcagaacacuuuaaguugacaaaguugaaagagcucuaugaaaaacaaugucaaguuuuaaaaagauuugauagacccaauccuucuguuccaauagccauagcacauuuauauccuccaggcccuauaaauccacauuacucagcagcuauggcacgagaagcugagaaaaaaaauucaaacccucuuaaaaacacugcaacacaaacuaguucuaaggagguuggcuuaaguaccauuaguaauaaaaauucucuuauaaauucgaggcgcucaaaaggacaagauaugccaacucaggcuagcaguuuggcagaaaaauuuagucaaaguaugauggaucaggagcuugaugauga

SEQ ID NO: 860 - RNA, 398 nt, Artificial Sequence
  Synthetic
gauagcguauuccauuagguacucuuaacucugcuacauuacaagguauuucagcuaguaaaagcaacauuucuuguaucaaguucucguuccacuuauguuuuuuuaauauuucaaaacuagcagcaagauaccgucuuguuaggagcaaaaauuuuuccauacguaaaacaucaaugcugguccacucgcguugcaugguuugccaaaauccacguagaaauggaaugacacucucaaguggcaguaugaagauuaacugagcuaaugaauuggcuagaccuugcugugcgagcggucgaucagacauccacaugcaauaaaauaggccuuuccauaauuucaguauuucaauaggugucaaaucucgucgaccugaaagauacguucuuaaugau

SEQ ID NO: 861 - RNA, 389 nt, Artificial Sequence
  Synthetic
uuccggcaaauuuguuaugcaugaccuucacaaaauaggcggaacuccaucgcugaucaaacuucuucugaaagaaggaauuauugauggcucgggcauaacaguuacgggaaaaacgcuugccgaaaauguucagaauguaccugauuuuccaagugaucagacaaucauucgacccuuuucuaauccuauuaaaaaaacagggcauauucagauauuacgaggcucucuggcaccugguggcucuguuggcaaaauuacuggcaaagaaggcuuacgauuugucggcaaagcaaaaugcuuugaugcugaagaugacuuuauuacugcgcucgaggauggaaagauuaaaaaaggagaaaaaacgguuguuguuauacgauacgaag

SEQ ID NO: 862 - RNA, 394 nt, Artificial Sequence
  Synthetic
ucaggcaaggguggaguggguaaaaguacauuuacaacacugcuugcacaugcacuugcaaaagacccggaaauugugguuggugucauggauacagauauuugcgggccaaguauuccaaaaaugaugggaguugaggaagagauuauucacgucaguaauacaggauggaguccaguuuggguacuugaaaaucuagcaguaaugagcgugcaauuuaugcuucccaaccgagaugaugcaguuauuuggagaggaccaaagaaaaacggccugauaaagcaauuuuuaaaagauguagaauggggcgaaauggaauauuuauuaguagacacuccaccaggaacaagugaugaacauuugagugucaacacuuuuuugaaagagaguggaa

SEQ ID NO: 863 - RNA, 398 nt, Artificial Sequence
  Synthetic
aucagaggcuguuaugucugauuugaacacauggcuauacagaauuagagaaacaucacaauuucuuggggagguagcauuuuaucauaccgaauugagaagaagccgccagaaagaaagaauaaagacaaauccucuacucggaaaauuuaaacuaaauucugccauugagcuuguauuugaugagacugaagaauuuaacguuuuggauaaugaagaguugcaggucgauuuuacuccacuguuugaauguaugcauauucaugaagcuuuaggucaaagugacaaguuuaagucucaauaugcugcuacaagaaaacaacaaaaagaguuacuuuuacccaacucagugaguuugguugaugacgaugaaaaaaguuuuagcggacuauuagaaa

SEQ ID NO: 864 - RNA, 396 nt, Artificial Sequence
  Synthetic
uaaucucgaagguagucccgaagaucugagcucgcacaaauucugccaugaugagggaaauuaucguaugaaacuucugagagcugagaagugauggugaacuugauggagguggggucggaaaagcgugaggaaaagugcuagugagacgcaagauccgcagaguuauuuagucguuuuauaguaucauuccuuguaaaauguggguuuauuauagucacucugucucagaccaaagauccaggaagucuaccuacucacagcguagcauucaaaaugaggagccucgcauaauuucagucauaaauaugaaagaacaaaguacauuugauagcucggguaacuagucggagcuugaguuacugcccguagcuuauguugagagcuaaaaauaug

SEQ ID NO: 865 - RNA, 397 nt, Artificial Sequence
  Synthetic
aucgucgcuucucuucccucaaaacaaauacaggagaaucaauaacccuaauuaaguuggauaagucaggaggauguguugacagggaugaagaauacuugaggcagaguagagaaugcucuauuaaagaauacuucuuuggcguaccuaauaguacuuuaaguccucauacgcuccagauuaauuuugacgagguuuuuauuuacaggauuaaagagauaaauucauuaucauuuaugccuggaggcgaagaaauuuuugaccaagaauuauacgaaaaaauagagccuaaucuaucgaugaugaauuguauucuugccguaauguaugcgucaggagcagacucacaggaaacaauacgagaugcaaguguuaugggcuuuguuuauguuucuga

SEQ ID NO: 866 - RNA, 398 nt, Artificial Sequence
  Synthetic
cgcggacagaugagauggguaauacauuucuuggggauugugauucauugcggagaaagguucgugagcgcaaauauaauuuggugcgauuggagaaguauuacuauacgguguuugcgccagagauaaagguaauccugcacuguugggcagcaccggagacggaguuuugggccccguagaagauugacuaguugaauaaggugauaaagagcuaccguucagaacaacggaggauguuaucgaaccaagacguggagaguaagccuguggcggcugggguaaagguaaaugaggcaaccgaucauucacauauggcgauuuuugaccagcguaaugauuauagagaggugcgucaguagguccacgaacuuggacuugggauauugaugggagau

SEQ ID NO: 867 - RNA, 375 nt, Artificial Sequence
  Synthetic
aauagcaguuugaguugggguuaauaaugaguacugagccacaaguacuagacacuggagagucuugagaucuuucggccugauaacuucuucuaaaaacucaauggcggcuagauaauaacuaucagcuaacccagcauacgcagaguccaauuucuguagugaaauagagaguacuauucgaacaacaaaguucugauaaggaucagaacuuccaucauaaacaucaaguauaucucuuuuuaaagauggcucauguaguguggguguuaaauacugugcuuuuugauugaagacuuccagcaauucuuccguaaccgaaagacuggguaauacuugugcugguaaagcgcuaacucuaggauauuucuuuuu

SEQ ID NO: 868 - RNA, 398 nt, Artificial Sequence
  Synthetic
aucagcguuguuauuuuacccgauuauugucuacggcgaacguaagucaucauugacugugccagaguuaagaguaaucaugucgucuuuuacaccauacccgcagccgcgguuacaaauauaucaagacccagaccaauccgccaccauguuccaaacuaugaaucagacaaugucacaaccagcacaacuuggacgcuuaagagacgcaucggcgagaaucaauauuauguuuaaucccccuccacaaacuguuaccgccacgaaaucuccccaaaagacagcuuggaggccuuccaaaucucauucacaaaccucucucagcaauaaauuaaacauggugcugauuccaccaccuggaucuaauaaugucuccaccgacuccaucucaaaaaagc

SEQ ID NO: 869 - RNA, 241 nt, Artificial Sequence
  Synthetic
uauuagggagaggugaaacuuugcccucuuugauuuuuugaauuaguugaaaauguguuuuagcauugaaaggugguucucuagagcauaguucauaaaugaugcagccaagggcccauauaucagacuuaagcguauaucuuucugcagcacaaauuucuggggacauauagaaugggguuccuacauaugucgaugcaaaaucgugugauuucauuaucuuagagaggccgaagucacc

SEQ ID NO: 870 - RNA, 392 nt, Artificial Sequence
  Synthetic
auugucguggauuucaagucuuugauaaagaaaugacuggguuuauuggugugggacaacuucgauauauccugacaaauuugggcgaaaaaaugagugaugaagagguugaugaauuauugaaagcagucaauaccucgaguggagagauuaauuacauagauuuagugaagacuauucuagcaaacugaggaaacgaaaaaggauauuauuaaaguguuggcucuuuuugguuaaucaugggaauaggaauucauuuaguaauuuacuuuuauacguccaauuuaggaguuaauguggaaccacgauaauuuuaugugaugaacuaaggguuaaucagugaucagugagugggcugcuuuugaccgaguucauuucaugaauuaauauaa

SEQ ID NO: 871 - RNA, 378 nt, Artificial Sequence
  Synthetic
cacgaauacguguaauuccuucucucaugauacuuucucguuucucacauugcuuuuugaauuuagaaaaugcuagcguuucuaaaucuuuuuguugagcuuuuaaaucguugaucauggccauuugcucgucaauuuuuacuaaaaaguccuugacaugccuauuuacauugaauacguuucugguaaccuugguuugaauauuuuuugcucgauuugcauaacgcaauguauucugagucucaucaaaaugugcacuagacggacuuacgcaaacaaucauuacggucuugcaauugccaccgagagaaaacuuuagcagucgaguuaacuuugaauuccgauauggaacgugguuuuuuuuucggggaucacaaa

SEQ ID NO: 872 - RNA, 396 nt, Artificial Sequence
  Synthetic
cccagcuucauuagaguggucaaagaaaccauuguaggugugaauaggaggcugaacuagagauaagaugguauuaugcagaauaugacaaguaggauugcauugcuuaucuuuaauaaucucucucuuaauuguuaucuuagaagcaaaguuaguuucaucaucgcuuaauuuuaaauuaauaagugaaacuuugcuuccauaaggugagcuacaaggugauggcugaauuaaaucuucaacuuuuuuauuaucaguccuuauuucuaggucauaugaccuagaaucuucuauaaauuuucuaagcuuauuugaagaauccuuaguagguguuuuugcaaugaaacgauuauuuucuucagguaagauuguagcgacgcuaaccgaugacucagu

SEQ ID NO: 873 - RNA, 398 nt, Artificial Sequence
  Synthetic
ucaagaagaaauacuagaaauuuaagugcaagguuaaaaguugacgaauuagaagaugaggaaguagguuacagaaaggaaaagacccgaaguccaguaaagaaaacgcccagggccaguaguaaacacgcccggguaagugauacugaaacagggcuagaucaagacacgagaaggaagucauugaggagcaaaaagagugaaacaccaucacaucaccagguagauuaugucgaagucaaccaugagacccccgauaaacuucccagagaaaagguagaggaacaacaagauagugcguucacuuaugauaauccauuucaaagcgggagcucaccucuauucggaaaaaguaaugaggcaaggagaaaaagucaagguaucaauaaagaaagaaa

SEQ ID NO: 874 - RNA, 398 nt, Artificial Sequence
  Synthetic
aagcuauuagcagcaaaacuacaccaaucaaacaaaguucaccuucaucagaaaguccagucuuuaaaaagaaagguggguucuuccaaaaccauggcccuuuccggcguaaaaguaacaaagguuauaauaauucucguacuaugacaccaucgaaucgaaauacuuggucuucuagaucuagagcaaacacaaaugauacuucacugaaggaucaaauauuuagccaaaguacaaaaagccaggaaaacaaucgauuaagucgcaguccagauacgauaaacccuauagcaaauuugcagcucaauguagggaacaacauauuugauguagaaacaccuaagcaaaguagccgugccauucaaagcccugagguacgaaaagacgaagaauuagau

SEQ ID NO: 875 - RNA, 204 nt, Artificial Sequence
  Synthetic
aauuccaaauuugaucccaguuuuguccgucacuauuggaaagagaugcuugagugccuacaagcaauacacgcacaugaugucguucauucggauuuaaagccgcacaauuuuguccuaguucaaggccaacuaaaauuaauugauuuugguaucgcaaaugcaauacaaacugaugagacugugaaugugcaccgugagacu

SEQ ID NO: 876 - RNA, 371 nt, Artificial Sequence
  Synthetic
aaauaugagcauauacucgguacauucucuuaaaaacuugucggauaauacuuggaaacgauuuugggaaaggaacuccaguuuuacuuggaaauauagcuucauuaucgauacuacucuggacccaucccauuaaguguucaauguacguaggggcagccaucuuagucggucguuugaaauuuucagggucuugccaaagauauucauacucaucagucgcuuucaucucaggacaggauugcggcgagcagaauucuguuaucgacccguacaguaaauuaauaugguuguaaaaaucaaccaaguugacagcaagccauucauuuucaucuucaccuucggguaaccuuacuaucuuucgaaggcua

SEQ ID NO: 877 - RNA, 355 nt, Artificial Sequence
  Synthetic
uuauuuguggcgaccuaccgaaaauaaucgaagauucgcaaugagugaugaguuagcacaggacgaugaagguuuugaaauauccgacuuuggaguugaagacgaugaaauagagucuacuauaggccaaaaagaagauagagaucaaaggccagaagagacgagguacaauccugcgccgaaaaauuccggacgaaagacuguaaaaaauacaacacgugagagcuuagaaagagaaacgauauuuacuguuggugaagacggggacaaauggucaaauaaugauagugacgaggagcauguuaaucucguuagugggucaaacaagccuucuuagauuuacgacaauuuuuuu

SEQ ID NO: 878 - RNA, 384 nt, Artificial Sequence
  Synthetic
cugggaguuagcagaccaccaauguaucauagggauucauuugacaguaacuuuucugccggaacaacaaccucuguuuacuuaccaagacggguugagaguauuaugggugaagaagauagaaaaaaguacgcuauagcucaagcgaaucaaguaaggacuaacccaaauccgauugggucauauuauccauacggacaaguauaugagauaucagagaaugauauaaauaacgggacauauaaagauucaguugagucccuucaaucagauucauaugguuaccauagaucacacucggccaauagugugaggucgcuugaaccguauggggagguaggagaggaucuuuugucuccugugagcucaucuaaucuucccaua

SEQ ID NO: 879 - RNA, 387 nt, Artificial Sequence
  Synthetic
ucgggaaagcugauugagccagacgauaauauuaucaauuaauugcaucaucaccgguagacguggcuugcacauaaauguccauuggcaaaaugauuuagauuuaggaccaagaauagggugaucggaauaaugcggcauaucaaucucgaccccuacaaucauaucaaugucuuucucguuccaucgcucuggaauaaaacguucaauuggacguaaagcuucgacaucaaugucagcguauagaccuccuuccacauacauaaucaaauaacgaaggaggucagcuuuaauaaucuuugcauuaagaguucuguauguauggacaauguccugucgauuuaagccugcaggaccaaaaugauguucaacauaauccaugucauu

SEQ ID NO: 880 - RNA, 360 nt, Artificial Sequence
  Synthetic
uucggggcuauggauugggcaaugcauugcucuuuauuugguggggauuugugaauggauaauugucucuuuaagugauugggaaaggcagguaaagauggcuuuugaacgaauggauagucccgaaguauuacaagaagaagcacaaaauuuauggaacgaaguauaacgaaauuuugacauuuuacguccaaaggacgcguaaccaaaaggauaaaaaaacugaguuggcaauuauauguacgucgcaaagaaacucuaauaucaauaugcaacaaucacaaucucuuuccgaguauccacaaaacgcuucaaauuuagcacuucaaacuuaucauuagaugauacacucaugauuuu

SEQ ID NO: 881 - RNA, 363 nt, Artificial Sequence
  Synthetic
uagaaauaccuaauaauaacaugugagaaaaugaagugaaucaucuacgcaauaucaguucugccuacgaacagcgcuugacccgaaauuaaauaagaaauugcaauuccuacacccuucuuagucuaauuuuguugcuauuuagauacacacugucaacccucaaaaggaccacuagaaucgagcaugaguugcagcuugaauauucgaguaugggaacagaucaaauugucucagagucugaucuaacuaaaauaaaugagauaacccucuaagaagagauggacaauaugggauuaucacaguguggaauuggugugacgggcaauuaugacacuuuggugcauuuuuaugccuuaauuu

SEQ ID NO: 882 - RNA, 398 nt, Artificial Sequence
  Synthetic
ccucucgccauuaaauacucauaaaauauccgcacguacaguucucuucacuucgguaccugcuaaauacagagaugaaucuaaauuacgucagauauuuggcucaugcgugaaaaagguuuggauaacaaaagacaguucagagguugacgaccuuguaucugagcgcgacgaucuccuacuaagauuagaaucaucugaaguuaagcuuauuaaaauugcaaauacagagagacucaagauuaacaagaaaaaagcuggagauaauaacucaucaucugaagucgcagcuccugucccagcaucucuaguugacuacuggguuccagaaaauaagcguccgacucauaagcuuggcuuauuugggcuaguuggacagaaaguugauacgauuaaau

SEQ ID NO: 883 - RNA, 398 nt, Artificial Sequence
  Synthetic
accguccugaaaguaaaggugaaaagaaagagcgucuucucaaggaagcuacagcuauuaaaaauggcaacaaggaggaugucaguaagaagccauacacaguaaaguauggacucaaucaugucguugguuugguugagaauaagaaagcuucucuagucuuaauacccaaugaugucgauccuauagaguugguuauauuucuuccagcucuuugucgaaagaugggaguuccuuaugcuaucauuaaaggaaaagcuagacuugguacuguuguacacaagaaaacugcugcuguauuggcaauaacugaaguucgauccgaagauaaaucagagcuaucaaaauuaauccaagcuauuaaagaaggcuacucugagaaauaugaagaagcuaag

SEQ ID NO: 884 - RNA, 397 nt, Artificial Sequence
  Synthetic
ucagcgacaaaucuugcugcaucaguaacuuuuuggaucugaaaggugaaguuuuccauauccgcaaucagacggguauuuaccagcuggucauuagagacagcuucaugagcugcuccuuucuccauuaucuuagagagugauuugaguuuuuuagugaaaaccgguaugcuuauuucguacagugaaggcauuuucaaaaguggugacaauaauuggauuuuucuagauguguagguagaaagcagauguaugguuuggacagcauaguuaauugggauuugcgugggcucuaauacuguacucugccccgauuauucuugaauuuugcagcugccaguuuuauuugaagaauccuugguauuuccaaaucaagcggaucuaaaauaauucgauu

SEQ ID NO: 885-899 - skipped (15 entries)

SEQ ID NO: 900 - RNA, 395 nt, Artificial Sequence
  Synthetic
uaacgagagagaauacacgguaaagacaguaguauggcauaugaugcaaaauguagaaaagauuguaauugaguuggcaguaaguucauucacgaaaaaugaauuauuuuccacaccauauccgggcugaggaaggaagacauuuguuuucaagucaaguuaaugaaaaaaccaaaaauaaaacucaaacacacagugaguaauuuuuauuaaggugguccaauaauaauuuuuucugacauguacuccuuguaguuuugagaugaaaauagagauaauauugagucugucguuauccgaaacaguuuauguuagagguugauaaaugacgauacaaaauguauauauuaggaaaucaauuuaccgugaccaaugagaaaagaggaggucuaauu

SEQ ID NO: 901 - RNA, 398 nt, Artificial Sequence
  Synthetic
ucaaguccacuucgauuuguaaagcaagaaguuaugagaccuugagaaugacugagguaggccgaauaagauuuucagauucuaaaauacuggauuuugguaccaauucaugauccuuucuggcccccuuacauuggcgacaaggcagauagucaucgaguuggucuuuuccagucaaagaaugauaaucuccaacgucuuuccgggaaacagaaguuguauugacauuaauuacagcuguggaugaggaugaacgauaauauuggcguugagcuacagggaagggauucaacagaugccauugccauucauaauuuccaugaagccaagucguugaagccagagaugcaaguguauggaagaaucccaagagccaauugauugaagacagaauuacu

SEQ ID NO: 902 - RNA, 379 nt, Artificial Sequence
  Synthetic
cuggaauuguugcacuggccauguaaagcaguuuaugacucgucuaaauauuuaauuacggcuaugcacggagagcuugggguuacuguuuuuuuuucucaaaaauaugccggugggauucgaauugguccggauauuuuuucuguaaauaauugagugacggcuuuguacucgugauaauuacagacaaaucuaauauaaugugcuuauccuucuaacgaacuucggagaaugauuuguuuuauugagugauuaguugacuuguuuuauuaguuaugguuaucaaacgaucacauaaaaaaacgcauacuuuuuacaaugaagugauuguauaccaauguuucccuugguggcccucaaaaaacuaaguuagauagau

SEQ ID NO: 903 - RNA, 396 nt, Artificial Sequence
  Synthetic
uaucccugauuucuauagucugaugaagaaugauuuuuguaggcaauagacuuucuucucuucccagaacagcagcuucuacagcauccacaacagcuuaggaaagagaagcaagaacaacaaaaugaguauccaaagcacaagcagcgugucauacaaaugauaauugagaggacuauuaagccaccgauaacaaguccgauuauugcuggccauuugcaauaaauuuguaucaugcauuuaucccaguuggugaaugaagaaguaacguuugauacuugauuaguuaauugaucacucaacugaucacuuacaagccuuggccuaagcaaacuaaucuccaaaaaauucauguuuccaauauuaacaccuccgugaucuucauuaaauaaguaa

SEQ ID NO: 904 - RNA, 250 nt, Artificial Sequence
  Synthetic
guugaaaaagacaauauuucgaaguucccgagagcuuucguauccggcaaugacugcaucacgucgaauuucuacgauccaagacgaaaauaguuuguuuuuuugcuguuggcguggagucuagcuguuguguacccgaacccuauucggaucaucaaauaggauuguaaguugguucaucauuuuaugaacagauucaaauuguauuaccccauucuuaaucaauaccaugcaggugugacugacaguc

SEQ ID NO: 905 - RNA, 400 nt, Artificial Sequence
  Synthetic
caauugcugcagcaugaccuucucuuggaaccgguauauauccuaugcaguccaaaagaguccaggaguucgguaucggaucauaacaccaaacaucguuauaccauugaagaccauuuguuccgccaaacaaguaaagcuuuucauuauaugucacaacugagugauuuguucuagcugaugguauuuguccuacuggggguccaccauccucacuauuuuuaaugagaauuucccaccuguucguagggacuugcaaaagauucaaaucaaaagccacaaggucauucauaaaauaacccucuacuugccccccgaauacguagauuuuagacccuaguauauugagagaaugaccauaacgccccgcgggccguggcccggcagguauagcucugga

SEQ ID NO: 906 - RNA, 350 nt, Artificial Sequence
  Synthetic
cuuggaaccgguauauauccuaugcaguccaaaagaguccaggaguucgguaucggaucauaacaccaaacaucguuauaccauugaagaccauuuguuccgccaaacaaguaaagcuuuucauuauaugucacaacugagugauuuguucuagcugaugguauuuguccuacuggggguccaccauccucacuauuuuuaaugagaauuucccaccuguucguagggacuugcaaaagauucaaaucaaaagccacaaggucauucauaaaauaacccucuacuugccccccgaauacguagauuuuagacccuaguauauugagagaaugaccauaacgccccgcggg

SEQ ID NO: 907 - RNA, 300 nt, Artificial Sequence
  Synthetic
aguccaaaagaguccaggaguucgguaucggaucauaacaccaaacaucguuauaccauugaagaccauuuguuccgccaaacaaguaaagcuuuucauuauaugucacaacugagugauuuguucuagcugaugguauuuguccuacuggggguccaccauccucacuauuuuuaaugagaauuucccaccuguucguagggacuugcaaaagauucaaaucaaaagccacaaggucauucauaaaauaacccucuacuugccccccgaauacguagauuuuagacccuaguauauuga

SEQ ID NO: 908 - skipped

SEQ ID NO: 909 - RNA, 350 nt, Artificial Sequence
  Synthetic
guaacaauaucaccauguuuaacccuaagguugugucggacaacacgauucauacgagcacucccgucaucuaaaucaucaucugcgaguacaauuaaaacaguauccuuucgcuucuuccccuuaacuaggacaguaucuccacgaaaaagcugcaaaguuuccaugguauuauuugacagugcaauaacagaguuaucaucguugauggcaucuguuacaauuaaggaauuuggcuuuuucuucuuuuuuaaaauagcagucgcaguagcaucaaucgucuuuuguucagcgccagaggcauccucaaguuuaacuguuuuuuuacgaguagcauugucuucagacau

SEQ ID NO: 910 - RNA, 300 nt, Artificial Sequence
  Synthetic
uaagguugugucggacaacacgauucauacgagcacucccgucaucuaaaucaucaucugcgaguacaauuaaaacaguauccuuucgcuucuuccccuuaacuaggacaguaucuccacgaaaaagcugcaaaguuuccaugguauuauuugacagugcaauaacagaguuaucaucguugauggcaucuguuacaauuaaggaauuuggcuuuuucuucuuuuuuaaaauagcagucgcaguagcaucaaucgucuuuuguucagcgccagaggcauccucaaguuuaacuguuuuuu

SEQ ID NO: 911-912 - skipped (2 entries)

SEQ ID NO: 913 - RNA, 350 nt, Artificial Sequence
  Synthetic
cugucaauauuacagcuugauaugaaucaaacugggagagaucagaaacuaagcuuguggagcugugaaucuuaacagggguguaagcauuuaguuccgaaacucguugagcugagacaauaucucuagguuuuccuauaucuucuggguuaagaaagaauugagaugauaggucagcgauaguugcgggagcgggaucguauaauguuagacuuuuaacuccagccagagcuauauucuuagcuauuucgauaccaagaccuuucaagccaauaauaagaauauucgaugcacucauucguuucauagccucguguccaagaacguagaguugccuacuguauaaagac

SEQ ID NO: 914 - RNA, 300 nt, Artificial Sequence
  Synthetic
aucaaacugggagagaucagaaacuaagcuuguggagcugugaaucuuaacagggguguaagcauuuaguuccgaaacucguugagcugagacaauaucucuagguuuuccuauaucuucuggguuaagaaagaauugagaugauaggucagcgauaguugcgggagcgggaucguauaauguuagacuuuuaacuccagccagagcuauauucuuagcuauuucgauaccaagaccuuucaagccaauaauaagaauauucgaugcacucauucguuucauagccucguguccaagaac

SEQ ID NO: 915 - skipped

SEQ ID NO: 916 - RNA, 400 nt, Artificial Sequence
  Synthetic
augagcuggucuuucaguggaauaucugucaauauuacagcuugauaugaaucaaacugggagagaucagaaacuaagcuuguggagcugugaaucuuaacagggguguaagcauuuaguuccgaaacucguugagcugagacaauaucucuagguuuuccuauaucuucuggguuaagaaagaauugagaugauaggucagcgauaguugcgggagcgggaucguauaauguuagacuuuuaacuccagccagagcuauauucuuagcuauuucgauaccaagaccuuucaagccaauaauaagaauauucgaugcacucauucguuucauagccucguguccaagaacguagaguugccuacuguauaaagacucaucgauaacauuauuauuuucuu

SEQ ID NO: 917 - RNA, 350 nt, Artificial Sequence
  Synthetic
uguagccgcaacaguuucagcugucccagcuaguccuucugauugaaguuuaucauuaguaaucccuuuagcgauggcgccauuaguaccuucgguugaguugccaacauuagauacuucgccagcaccaucagauacauguguaguuaauucuucagaggucuuguccggacuaucuauugcgaucuuuacugcaaucucacgaccuugaacuucuuuuccauucauuucggcaacagcccuauuuugaaguucauuagaugcuaaguucacaaagccaaacccacggccuuuccgagguucguugcgggccugaagcuuuuuaaccaugaauuuuggaauaggacgca

SEQ ID NO: 918 - RNA, 300 nt, Artificial Sequence
  Synthetic
ccagcuaguccuucugauugaaguuuaucauuaguaaucccuuuagcgauggcgccauuaguaccuucgguugaguugccaacauuagauacuucgccagcaccaucagauacauguguaguuaauucuucagaggucuuguccggacuaucuauugcgaucuuuacugcaaucucacgaccuugaacuucuuuuccauucauuucggcaacagcccuauuuugaaguucauuagaugcuaaguucacaaagccaaacccacggccuuuccgagguucguugcgggccugaagcuuuuua

SEQ ID NO: 919 - RNA, 250 nt, Artificial Sequence
  Synthetic
uaucauuaguaaucccuuuagcgauggcgccauuaguaccuucgguugaguugccaacauuagauacuucgccagcaccaucagauacauguguaguuaauucuucagaggucuuguccggacuaucuauugcgaucuuuacugcaaucucacgaccuugaacuucuuuuccauucauuucggcaacagcccuauuuugaaguucauuagaugcuaaguucacaaagccaaacccacggccuuuccgagg

SEQ ID NO: 920 - RNA, 400 nt, Artificial Sequence
  Synthetic
uuaaaaguugcgguuuaacuuaagcuguagccgcaacaguuucagcugucccagcuaguccuucugauugaaguuuaucauuaguaaucccuuuagcgauggcgccauuaguaccuucgguugaguugccaacauuagauacuucgccagcaccaucagauacauguguaguuaauucuucagaggucuuguccggacuaucuauugcgaucuuuacugcaaucucacgaccuugaacuucuuuuccauucauuucggcaacagcccuauuuugaaguucauuagaugcuaaguucacaaagccaaacccacggccuuuccgagguucguugcgggccugaagcuuuuuaaccaugaauuuuggaauaggacgcagagcaauuuuggcagauacugguuc

SEQ ID NO: 921 - RNA, 250 nt, Artificial Sequence
  Synthetic
ucauggaaagaguaguuggauacgagauauagaaggcugugaugccuucagugcgauagauauagcgggcacaaucacucagugaucuauaaauuuugcgagaguuaugcauuugcauucuuugcuuuauuacaucaaauggguucauuaaagcaucacuugcaauuguugcgcaugccccacuuguaacuauguagcuucaguaagugcucaauaucaaggauaaauuggcgauguagucauauauguc

SEQ ID NO: 922 - RNA, 400 nt, Artificial Sequence
  Synthetic
cguaagccuuugauggguucagaaauguagauacagauucguaugcgagaaguugaagugcuguaaaugguacagucauggaaagaguaguuggauacgagauauagaaggcugugaugccuucagugcgauagauauagcgggcacaaucacucagugaucuauaaauuuugcgagaguuaugcauuugcauucuuugcuuuauuacaucaaauggguucauuaaagcaucacuugcaauuguugcgcaugccccacuuguaacuauguagcuucaguaagugcucaauaucaaggauaaauuggcgauguagucauauaugucugauuccuuaaucaaaauucuuaauacagaccugcugcaauaggaugaugagcuccuguuugauuaccucccaug

SEQ ID NO: 923 - RNA, 350 nt, Artificial Sequence
  Synthetic
uguagauacagauucguaugcgagaaguugaagugcuguaaaugguacagucauggaaagaguaguuggauacgagauauagaaggcugugaugccuucagugcgauagauauagcgggcacaaucacucagugaucuauaaauuuugcgagaguuaugcauuugcauucuuugcuuuauuacaucaaauggguucauuaaagcaucacuugcaauuguugcgcaugccccacuuguaacuauguagcuucaguaagugcucaauaucaaggauaaauuggcgauguagucauauaugucugauuccuuaaucaaaauucuuaauacagaccugcugcaauaggaugaug

SEQ ID NO: 924 - RNA, 300 nt, Artificial Sequence
  Synthetic
aguugaagugcuguaaaugguacagucauggaaagaguaguuggauacgagauauagaaggcugugaugccuucagugcgauagauauagcgggcacaaucacucagugaucuauaaauuuugcgagaguuaugcauuugcauucuuugcuuuauuacaucaaauggguucauuaaagcaucacuugcaauuguugcgcaugccccacuuguaacuauguagcuucaguaagugcucaauaucaaggauaaauuggcgauguagucauauaugucugauuccuuaaucaaaauucuuaau

SEQ ID NO: 925 - RNA, 400 nt, Artificial Sequence
  Synthetic
augaagugcaggauuuuucucuauaaguuucuuacguuguagcgccgaagcuucucuaaguuuaaucucugauggagauaaaacguuauauauaggcguaccaacagcaauuguccccucuuuaaguagauauaacuuucgcuuaucuuugucucggucagugcggaaguuugucccagcuucuguaaguuuuacagcuuuuucucgauuaacugcucuugacacuugaaguacgcgaccuucuauuguguauaagccauucuuaucagcaguuucauccucuaaaauagaguuuuuagcuuuaacagcguuugcaccacuuuugaagguacgaggugcaccaugguaacaagaguccgcaucuucuugucuauagaagcaaacaaagccagugccuuua

SEQ ID NO: 926 - RNA, 350 nt, Artificial Sequence
  Synthetic
aguuucuuacguuguagcgccgaagcuucucuaaguuuaaucucugauggagauaaaacguuauauauaggcguaccaacagcaauuguccccucuuuaaguagauauaacuuucgcuuaucuuugucucggucagugcggaaguuugucccagcuucuguaaguuuuacagcuuuuucucgauuaacugcucuugacacuugaaguacgcgaccuucuauuguguauaagccauucuuaucagcaguuucauccucuaaaauagaguuuuuagcuuuaacagcguuugcaccacuuuugaagguacgaggugcaccaugguaacaagaguccgcaucuucuugucuaua

SEQ ID NO: 927 - RNA, 399 nt, Artificial Sequence
  Synthetic
guuugccuuuccaaauauccaucaugcagcuuuguaacguaccucucguccuguuuggucuccucugcuuuggacuaguuucaacugcuccagcaccaaacucaccuuggcaucuacgaagccgacaggaaggugguggcuacuauggccaaccaucgaauggugauggaaguguguauccaccuucaucugguacagguggcuuucuaucgccaacugcuacgagcgguuauccgucugcaacuggaacuggcggcuauucaucuccaucgggcaccgguggcuacccgucugcaacagguacaggugguuacgcaucgccaacagggaccaguuacccuacaccuacuggagguuacucugaagagcccuaccacuauaaaggugucaagcuagguc

SEQ ID NO: 928 - RNA, 349 nt, Artificial Sequence
  Synthetic
gcagcuuuguaacguaccucucguccuguuuggucuccucugcuuuggacuaguuucaacugcuccagcaccaaacucaccuuggcaucuacgaagccgacaggaaggugguggcuacuauggccaaccaucgaauggugauggaaguguguauccaccuucaucugguacagguggcuuucuaucgccaacugcuacgagcgguuauccgucugcaacuggaacuggcggcuauucaucuccaucgggcaccgguggcuacccgucugcaacagguacaggugguuacgcaucgccaacagggaccaguuacccuacaccuacuggagguuacucugaagagcccuac

SEQ ID NO: 929 - RNA, 299 nt, Artificial Sequence
  Synthetic
cuguuuggucuccucugcuuuggacuaguuucaacugcuccagcaccaaacucaccuuggcaucuacgaagccgacaggaaggugguggcuacuauggccaaccaucgaauggugauggaaguguguauccaccuucaucugguacagguggcuuucuaucgccaacugcuacgagcgguuauccgucugcaacuggaacuggcggcuauucaucuccaucgggcaccgguggcuacccgucugcaacagguacaggugguuacgcaucgccaacagggaccaguuacccuacaccuac

SEQ ID NO: 930 - RNA, 249 nt, Artificial Sequence
  Synthetic
uaguuucaacugcuccagcaccaaacucaccuuggcaucuacgaagccgacaggaaggugguggcuacuauggccaaccaucgaauggugauggaaguguguauccaccuucaucugguacagguggcuuucuaucgccaacugcuacgagcgguuauccgucugcaacuggaacuggcggcuauucaucuccaucgggcaccgguggcuacccgucugcaacagguacaggugguuacgcaucgccaa

SEQ ID NO: 931 - RNA, 397 nt, Artificial Sequence
  Synthetic
uuccuggacaaccaguaaagaaaaaguugggaccaaaucaaacacaagaaaugauaaaguuugcaugucgaacaccugcccaaaaugcuaccucaguuguucaagauggaagacauguuuugagccugaacucuagcaacccuguucuaucugaauuuggccuucaaguaggucagucuuugauaucaguaaaugcucgaguacuacaaccaccgucugugagauauggaggaucuggaagucuaucaccgagaaaugguaguuggaauaugauuaacgugagauuucauacacccgccaaaaucggaccauggacuuguauuauguuucccacccaaggaagaaaugacauugauguugguaauaugagaucacaugucacugcuuuccaagcaca

SEQ ID NO: 932 - RNA, 397 nt, Artificial Sequence
  Synthetic
aacuacuaaccucgccgcccuauauaagaagaugggaacgcaaaaucgugucaauuugaaagaaaaguuaaaaggaaugcgaauccaaaucacacaucugcccccaaagauuaauaaaacaaccggaaagguuauaccaaggauuaaaaccauucaaggccuugcaaauauuaaugauggugccaaagaggagcaucgaccagagguugcuggauauggugcugguccucaaaaggucaaguuuuggguaucugaagauacuggcacuucuaaaaccagccaaaaaaaccccuugccaucuaacacuuacaucaguguauaugauuacuucaaaaaaagauacccaaagauugaauuggauccaauaaauccuguaguuaauguuggaaacagugaa

SEQ ID NO: 933 - RNA, 351 nt, Artificial Sequence
  Synthetic
aucugcaucaggcagcucguaaucuauguaaagaacgaaaccgucaguugcaguggaauauuuuucgcgauuuaauacagccaguucgagauccgaaggaugguagguggaaaaaaucagaggauuggaagaaccuacagaaaauggcuagauuacaguuuaccgucaaacaucgagggaaaaaugaugaucauaaagucuauuauauaaaaggauuuacuuucucuggugagcaagguggugcucacucuaaaaacacauacuuuagccuuaaaaauagaaaaaccgacccuccuacggaagagaaaauaucuguauaugauuauuuuaagaaaacuuauaauaucaaua

SEQ ID NO: 934 - RNA, 349 nt, Artificial Sequence
  Synthetic
cucccccagggaguaacuauaccugaaggguggucauuacuuccucuucaaaguauugaugaaacgauucucacacagaguacuagaauaucaccuaugguauuaaauccaacccuaaacucaaugccugugccugauacuaauucaggcacugaccuaagugguucaaagaaucauacugaaccugauucuggauugaaaaacucgccuuuaaauuccucgacggguucagcuaguaaaaacuugaaaacaccagcgucuaguucgaguaaaacuucaucgucagucauagaagaaaaugcgaauauaugauuauuacucuauuguaaccccuagauaacuauguaau

SEQ ID NO: 935 - RNA, 342 nt, Artificial Sequence
  Synthetic
uuacaauccaugcaccauccauuaagcgaaaauaaaccaucacuguugagaaagaaguuaaacgugauuugagcuguuauaagaguugaguuuaacacaguauuuugaauuuguucuaauccuguacuugcuauuuuugaaucuucgagugauggugcaagaucaacguugaaguguaugauagaaucuggugcaguuucgguacuuaaguacagauauguugcaaugccaaaacuaucacuagcaccacgcauagcaaagaaaauaucgggauuuguaucaucacuggcgaaaauuuccuguccaucagcaagaauaacauccauaccaacgaugugauca

SEQ ID NO: 936 - RNA, 398 nt, Artificial Sequence
  Synthetic
ccaggcuaaaucugugcuccaaacacagucaguaauacagacuuuaauugcugaguguuuaucuuuggggaaaacaaaaaugauuauugaucucuccucgaauaguggagguaauuuggucguugguuaugacacauuccgacaauuuuucccuaccauugaacagccagguuauucacgauuucgauuacacgaggcgcuaaaaauuauuacgaaacagaucucgaaaaucgcaucgaauuucucuuuuacaaguacaaaccccacugauuaugauuauuaccaaacuccguuuaauuauagauucgaucuaaaugaaaccaaugaaaaauuucuuagcuacgaggauaaauucaguccaagaaaauuuaauggugaugaauucacuagcaauauga

SEQ ID NO: 937 - RNA, 396 nt, Artificial Sequence
  Synthetic
auugcgccaaaaugugagguaaggauuacuaacuugcugagcuugaagaacucaucaacaccaguaucuuuagcugguaaacaaguuaagcaaauucaaagcaacuuaccaucgacaaguaaacaacuuggaauauuugcaaaagaaaacaucuuaccgggcgaaucaauccuuaaagagcugucauaucucacuguuaauaauagacucaaaggcccucuaugugaugcuuguagugcugaaauuccuucucuauaugaaacugaaaguacagcaaugagcugucucgagugugaugaaaucucauucuguagugaugaaugcaaacguggagcugagcucgaauaucauccagcaguaugugguaaagauguugagacaauuggcaaggacugg

SEQ ID NO: 938 - RNA, 306 nt, Artificial Sequence
  Synthetic
ucaacguaaauuuuauaagcaaggcucugguaaaguggaaccuuacuuuuuaauccucaacaaggaaggagaguucauugauguagucguugaagggcugaugaauaacuucauaagaugucaacaaacaagaaaaaucucuacagaauuaauuucagaugcaccuaaucaaccgguaccaucucaaauaucuggauaucaaugugguaaauuuuuuuuuagcaaugaggaacuugagaauacugcaaauguggcuagagauaucaugcuucagagaagucaaaauaaaauucccacuaaguauaa

SEQ ID NO: 939 - RNA, 327 nt, Artificial Sequence
  Synthetic
uucgcggugucuuccuuuccagagccuuuagucuuugaaggauuuucuucuucauccccaucuucacccuccgcuucugcauugacuucgucggccuuuuuugcuuuuuuuucuuccccagauuugccuuucguuguuagagcuccuaggccacuagcgagagaauuugaaccauuaccaccgccaacaagaacuccugcuuuaccuccuauggucaccucuugaauacucugacuuucauuuuccgcagcauuggcuugcuuuuuggaagaugagcuagagucaugugauuuuucugaauucgaugccuuauuuuucugaucuuuu

SEQ ID NO: 940 - RNA, 393 nt, Artificial Sequence
  Synthetic
cccgaaugaaugcuaucaacaugggauaguaguucacguucacuccgaaauuuuauauuacaaaacauacacucugcauguucuuuucgaauaugagccuguaacuuugaauaacuugugaagccuagauuuaauggcguaccaucugaauuaaaagauccugucaagcaacauucauuacagaaauaucgagcacugccaugagcucgcucuuggugucgacgaaggcuggcggaacuaucgaaaccugaguugcaacuuucgccagugacagggucaacauggacacagggauacggcauaagcugaagauguucagagcgaauaugacgcuggagaguuugauguuuucggaaauuuuggcuacaggguggguaauuuguacauuugaau

SEQ ID NO: 941 - RNA, 398 nt, Artificial Sequence
  Synthetic
uacagugacaacgcuacucgaaauguucuugacugcaaauccugauaagugucgaagagccgaagaacuggaggaauuaaagaaaauauacugccguggcgacuguguauuaccuaagguuguuaccggagaaagggaguuuucaucacgacaaagacgaguagaagacuccgauagaagccuugucgaugaaauucgugagauaaguuuacgagaagcacuuacagaaaccccaaauauucgaagagggcagaaccgacgagaccaugaggauucuagaaggccuagcuccucaagaacuaggcauacaaccccggaagcuagaauugcugacgagcacaaucacacuaggagacgaagaagagaagagcgaaacucuaggcaaagucaagaaaaca

SEQ ID NO: 942 - RNA, 398 nt, Artificial Sequence
  Synthetic
uuuggguuguuaguacuaucauuugugacacuuaucuuugauucaguagaugaguuagauggggaauucacauugacugcuaucgguuuuaguacagauggcgauggugacuuggacuugucuuuuuucauagucauuguaguuugggaauucacaaugggacuguuagauuucucccucuccucucgcacgagguuauuuuuuucuucaagauacugcuguaucucaagggacauagcuucaucauguauaagaucauccaacaauacaccuucagucugacaaccuggacagguaaagucgcucucgaugagcgaguuaguaaugcagucauugcaguacguuuucucacaacauggcguuuucauuggaucuaugaauauucucuugucgauuga

SEQ ID NO: 943 - RNA, 348 nt, Artificial Sequence
  Synthetic
uuugaaaaacacacaaccccagaagaauacgauagcauaucauuggccaagcacccucaguugcauguugaggaugauucauggcauagagcaacugguacuuguaaguguaauaacuguuaaugaaguauauaaucccaaaaaauagaaccauauaaccagccgguagaauugaguauacaauacacaaaauguauacaaggauugcagaggguagauaaaacccguauuugaagacaggaggcuguguaagcucccagcgaucccuagggcuuuuugaauacauacgcauaauuggauauagagacacacugccaaacucuaagagccuuaaugguaugaaaccaa

SEQ ID NO: 944 - RNA, 398 nt, Artificial Sequence
  Synthetic
aacaaggaaaucucuaauucuuucaauagcuuuacaaaugagaguuucaagaagagguuuuaagcugauuaugccuuuaauauuucgucgaucuuugauuuuugagucaaaugauuuggaccuuuuuucaacaucagccaaugcuuuuacccaugccucguccauugauccaucaacaauuuuccuaacaguugcuauuggaaugcugauuucuucaacaauaggaccgaguaucuguucaguauucuuucgauuaucuaaacuuaugcuuagagcauuugaccgggccuguaucguuucuauaucaacagagacuugcgccaagucaucccgaaagguuacuaaauucgauucaacugagcuuaauacuucaucgcaagcaagaauagaauugugua

SEQ ID NO: 945 - RNA, 396 nt, Artificial Sequence
  Synthetic
cugaaucagaugauggggguaaugaacguaugauaaauaguaagaaaccgcgaaguacaugcucgaagacccuaagggaaaaagauuugaaagaugauaaagaaaaguccagaucugaugcuguagcuaaaagaaauggucguacagagcggagaagaacugaagaucaagaaacacagaaggaauugucaauugguacuaaaaauacaaugugcaauagcacagacucuucuaaagucucuacaacgauugaaucucuugagucuccgacauuaucaaaugguagaguuucagacaauucaucuaacaaccaauuuccaauaccuuuaaaaaaaagcuaccguaauucaaauucuaggaaagggaaauuagccaaaaauaauuucacaagggaau

SEQ ID NO: 946 - RNA, 381 nt, Artificial Sequence
  Synthetic
uugaagugguuaaaaaacauguugaggaaacagaaugggaagaagaaccuuccaagaauggaagacuugauauugauauaauaaccgcggaagcaaugacacuugcucaucaaauugcaaguggugagaagacuaaauaugaucucaucgaugaagguuggaauaaaaauucauucaaggaucgcgauggccuuccugauugguuucuggaugaugagaguaaacaugauaaaccucauagaccuaucagugcugccgcugcaaaugcuauaaaagaaaagcugcgagcccugaaugcucgaccaaucaaaaaaguacgugaggcuaagagucggaaaaaauucaaagcugcccaacgacuugaaaaacuccgaaaaaaau

SEQ ID NO: 947 - RNA, 392 nt, Artificial Sequence
  Synthetic
auuguugauaaguucacuggaaaucuccguuauaggaucuauuccuucauuuuguuuccggaguuuuucuucuugucgagcacucauuuugguagagaaugcccaacaugaaaggcccaauucgcgacauacuaugcacacaucuagacgaggcgcaguuuugucuuucguuaucgcaauuccaaugcaacgacgacauuguaagacaaaauucucaugaccaauuuuaguaaccaagugaucucuguuacuucgaggaccaagacaauuuuuguggauugaaguugagcauccuugacaguaaauaaguuggcuugggcccuuguucgaauuucucucauuuccaaagcaaacaucacaaaauuuauuaugaaaacuucgaaauaaauuuu

SEQ ID NO: 948 - RNA, 393 nt, Artificial Sequence
  Synthetic
cuaacgagugaucgaagcccaucugaaagauuuugaguuaugcuuuuaccaacuauuacaguaucugagcucagucgcgagaguaaauccccgacucgauuggcgucaaagaacucggcaucuuguacaaauguccuucgaaauaauuuugaucggagucuugaaauuacucuuucuccaacuauucucagaauuaauauccguccauaauuagcuacagcaccuauugauaguauaagcccaagagccccgaaaaauuguugauuauuaaguucaaaaaguguguuuccuucugaguuuuugguugcaaggucuaauauuuuaccgauugaaaaaggaauugccauugauauggaugaagauacuaauaaaaagaaaaaugccaaacugagc

SEQ ID NO: 949 - RNA, 391 nt, Artificial Sequence
  Synthetic
aucaauuuuucauucucccuaauagauuugauaucccguucuuugagauaacuuaauuccucuuuuaugucuuuuagcuuuuuuucugcagucgcaauuagagucucuuuuucagcaauuugaucuugaagcucauuuucucuuuuuaaaaacucuucacgaucaucuuuuucuaaugcaauuggcguagaugagcgaucuaauaacguugaagcuuccgaucuagauucuaccugcagccuagaaggaguugcaggucuugguguuuuuauuuuagaaagauuagcaguaucuaaaggugguacccauuuuucuuuaggcacacuaucuccagaccuccacugcugaacuucugcaucaagugucuguacauauuguucaaauguaguaa

SEQ ID NO: 950 - RNA, 398 nt, Artificial Sequence
  Synthetic
uuccuaucgaauuuguaucguuuaccaacuuuggguuacugagaggaaauaaacuagcgggauucauuaucaauugcgaauuaaguagucucugugggauaggugaguuuggucgagaaugcguagguaaugaaaaauuaauagacuuucuagaaauggaaaggcuuggacuuggaauuggguauugauaauuugaaauguuagguccgccagaagauuccacacgcgcauuagaaucuaugguuaauuuuugugcugaaguuuuccggguccgcagugcuucauuuuuuuucaauacacuuuuacuuuucggcaugucuugaacaauaaggucgggcaaagaugggauaggaggcauguucacuugagaccauguggaggauaaaucacggaaugag

SEQ ID NO: 951 - RNA, 394 nt, Artificial Sequence
  Synthetic
ucuucuucagugguaugugcaagagauugacgucuagaugaacguguugauggugcaguuacuacagcaguagcuucaaccgauuuucgacucacuuuucgcuuguuugaaacagacgaaacuaaagaauuuguggaacuagauuuagguuuacgaguaguggaccgucccuuacuuguauagacucucuuuuuaaguguagaaucauucaauggcuguaaaaaugaaacuaaaucuccacaaauaguaguaggugcaucugcugauaaugcuucagguaaaucuaaucuagauccaauuucugauguacuaagugauauauuugaagagguaauauuacuuuguauuucaggugucuuugaggucaucuuugaugaaauuaccauuaguuuuu

SEQ ID NO: 952 - RNA, 398 nt, Artificial Sequence
  Synthetic
caccgcaggaaacaacacgaguaaaaucauuuucuucaacaacaucuucugcagcaaaaaaauuuucucgugcacucuuauggcggucaauuuguagagauugcucaucgaagacaaucugaccaucaacgaugcgaauuuuaggaccaaccggaggagcagacggcggugcgauuuggcuauuuaaacuuggcucagucuuucuacuuucauuuaggguauaauugucaccacuuuuuccaucuauauaaucuucaaguucaggguuaucucgcuucauccuagcuuugauagcauuuuguuucauucgugcaagucgucccauuaucucaucgugguuucuagacuuuuuaccaauacgaagaucaugacauaagucuugcaugguaauaacagaa

SEQ ID NO: 953 - RNA, 391 nt, Artificial Sequence
  Synthetic
ucgagguucugauaagacuugaucuaaaguagggaagagaguuucauggcgaaaaugccaucgauaggguguaugaagcgguauaauuggauuuaguuuauuaucacauccaauggcaauacugguuucgugcgcccaggcucuagcuacauuucuugguguauagccuccaccuccgaguaauaauagaggcagguuuaaagauuugcaaaaugcaacgcaagcuccauggccuugaacuuggacguugaagcgcccaagucgaucaccagcaagggagucagcaccacauuguagaacgagggcgguaggucgaaacuucucgacacauuuuccuacaacggccuuaaagagguaaauauauugcucaucaucaauaccaucugcaaga

SEQ ID NO: 954 - RNA, 398 nt, Artificial Sequence
  Synthetic
caucucaacgacuuuguagaauaaaucauagugagauacaggacuguguagaaaugccucaccacaacauaaagauaaggcaauuaaauuaacuagauugucaaucaaaauaucaauauuuuuuaagccccucaagucugauguguauguggugagaaaccgaacaagagaaagcagugaucuauauaguucagaccagugauauuucaaucguguccgugaccgagauagguaugauaauauacuauaaaugauaccaaugcaaagaauauauaaaucaacauccagucgucgucuuagauugugauugauuccaucaagcaucgcaucaagaagaauagcagcaaucgaucuaucuccaugaacauaaggaagguacggagauuuuugucgacaua

SEQ ID NO: 955 - RNA, 392 nt, Artificial Sequence
  Synthetic
aucggcaaaaguaaugcuucaaaagcugauacaaagacuauauggagaggagcuuuaaauauauuggaagacuuaaaaaacgcagaaaaggauuggagauuugggaaaacugaaauuguaggguuugacauugagagagagaaccaaauagauugcccucaaagugauauggaaaucuugcagcaacagucaagcaacacugcaagcuaugccaauaauuucaccuccgaccuuacaccugaaggccgcccaacaggaaaaguuacgaaagcucgauuucagucugcagaaauaggaaaauguacucaaguuggauggggagucguacaccuauaccgugaugauaacgaugcuguuaauuuugauacccgaacuacuacauacgauggaaa

SEQ ID NO: 956 - RNA, 395 nt, Artificial Sequence
  Synthetic
aagauugaaaauggaacgccuagaacagcaccuuuaauuacaacacgaaggacuccgaaaaugcuacgaucuacugugucaaauuccucgcuuuccucacaaccaucaaugucaccgcaucaauuuauugcucuugcccgggaagcaaugaaaaaugcuuuggaagagaacaaaucaaaggcagcugaggccaaaaguguuaguaaugaacuuaagccagggguuacgaucgauuuuagcaacaaacaaauccaacgauuuccugaugaaguaauugauauaauaaagaaugagcuugaaagacuugcgcugucacauaaucaaauaucuguguuucccucaagguuuuccgaaugcaaaucacuccgauaccucaauguuagagauaauguuau

SEQ ID NO: 957-971 - skipped (15 entries)

SEQ ID NO: 972 - RNA, 200 nt, Artificial Sequence
  Synthetic
aaaaguuauggcggaaaucacuauauauacugcuucacaugccuuacaaggagaagagguccgugagaauuuugacucaucuuuugccgcucuuuaucaugaucuugauaugggauuuacaccgaucaacuuuacauuuuacugggcaccucuaccuuggaaucgugcucgugaucaugcccaaagaacuguugcuagga

SEQ ID NO: 973 - RNA, 200 nt, Artificial Sequence
  Synthetic
augggauuuacaccgaucaacuuuacauuuuacugggcaccucuaccuuggaaucgugcucgugaucaugcccaaagaacuguugcuaggacuuauaugaauauaauccaagcucguagagaagagaaaagaagcggugagaauaagcaugauauaaugugggaguugaugcguuccacuuauaaagacgggacuccggu

SEQ ID NO: 974 - skipped

SEQ ID NO: 975 - RNA, 311 nt, Artificial Sequence
  Synthetic
ugccauucgcguauuuuucuauucgaagacacucaguccuucagagauuauuccagaauuguauccucaauuacaaucuuauuuuuacacaauaccucuuuccccuaaauaaaguacuacaaugucaaauuccgaauuagcaguuucguaugcugcccuuauccucgcagaugacgggguugacgucacagcagauaagcuacaaucauuaaucaaggcugcugguauugaugauguugagccaauuuggacuacuuuauuugccaaggcucucgauggcaaagaugugaaagauaugcuccugaauguag

SEQ ID NO: 976 - RNA, 397 nt, Artificial Sequence
  Synthetic
gcccgcuuccucagcuauucuugccuguuuugcguugaccacauccauaauuacgccacccuucaacaugcgagccaggccgguuuugaccccaaaauucuuuugucccacaggcuuugaggugccuuuauugauuccauuauuaacgccaccaucagcagagacaggaauagggauuucaguggccaucuugcaauuaucucauaaauagugguauuaguuaagcgcccgaagguucuugucaaauucuucuugcaaauauuaguaucaagaguuugcugaagauauaaaacuaagaaacgaauuguaauuaacaaauggauuguaaaauuucucaaaaugaccgccuggucgauaugacuaugacguuuagagccaggaaguguugcaggaaaaa

SEQ ID NO: 977 - skipped

SEQ ID NO: 978 - RNA, 398 nt, Artificial Sequence
  Synthetic
gucguaaugaucuuggccaauaauucgagggucaagcauucgagauuuagacucaaggggaucuaccgcuggauagauaccuaauucugaaauaccacgugauaauacaguaguugcaucuaaaugagcaaacguuguugcgggugcuggauccgucagaucaucagcuggcacguaaacagcuugcacugaagugauugagccuuugguaguuguuguaauucgcucuugcauaagacccauaucuacugcaaguguagguugauaaccaacugcagagggaauacguccgagaagagcagagacuucggagccggccugagugaaacgaaaaauauuaucaaugaaaaguaauacaucuuguccuucuucaucacggaaauacucagcaauaguua

SEQ ID NO: 979 - RNA, 398 nt, Artificial Sequence
  Synthetic
ccgguccaacucaagucagcaagcuucagccagaacaaaaggaugguaaguuaaggcaucuuccauuuaaauccaaacucuuaaaaucuuuuaauauuugauacaagugcgcagaaaugcaaagugaaacuugagaauuuuugcaggauguucggacuugauucugaaaugugaacugcggauucgaaaauuaugagcuaacaaacaacagccguucacuaaguuaguuaaaaauucagcauacuucagucgauaccaaacuaaauacaagcggcgucggauuggaaagacugacuacuaugcucguaagcgccucauaacacaggcaaagaacaaauacaacacuccaaaguaccggcuuguuauccgauuuaccaaucgugauaucguugcacaaa

SEQ ID NO: 980 - skipped

SEQ ID NO: 981 - RNA, 275 nt, Artificial Sequence
  Synthetic
uucggcauaucaacguaaaaaaaaaauaaaucgacacaaaacagcucaauaccguaguuuaucaccaugcuuacaauuacguaaacggaggucugcaaagagccuuaagucuuuggaaauaucaugcaguagugguauugaaaaaggaaccacuagcuucguaaacuauaccccagaagauucccagaagauuuuaaauggaguugcuccgucugggaguaacaagaccaaagcucgaagggagaaagaggccuuggaaaaacgccaaaaguuau

SEQ ID NO: 982 - skipped

SEQ ID NO: 983 - RNA, 391 nt, Artificial Sequence
  Synthetic
uuccuagucaaacgugcaucuaguggagguguacaauuuucucgugauccccuaaacuuaacaaaugugcauucucgcaaauaugccggauuuguuaacgauaaggcugucggaauucuucccauugaaggugguaaaggagguauuacuuugaucaccaaaaaaacuaaauuuacccaaaaaccuucuagcgccauauacacaacaguuuuuggugguaauaaaacuucaagacggacauauaaggggguugucaauacuguugucaaaucaagauaucgaucugaucuucgugcugaagcuguugcucgugcgucugcuauucgguacucgcaaaaaccaaagggugaucuuccuaagaagaaauugcguggaucaaaagcuaaaaagg

SEQ ID NO: 984-985 - skipped (2 entries)

SEQ ID NO: 986 - RNA, 240 nt, Artificial Sequence
  Synthetic
uugagaaauuauuuucucuuauagcgaauuugauugaguauuuuaugugauauucacguuguuggacccuuauagaucugggauuuagggucuuagaagacucgucuuaaagcuugccccaacguaugaaguauuaaauacguuacuuuugauaugaauauauuuuuuauauacacgaauuaauuuaaucgaagagaccaaagcccauaucuucaucagacucuucuucuuuuucuucuu

SEQ ID NO: 987 - skipped

SEQ ID NO: 988 - RNA, 339 nt, Artificial Sequence
  Synthetic
ccgccauacugggggauuagaaccuugucgccaaccuugacauuacaagacacucuguuuccaucuuugccaacugcaccagguccuacagcuauaacgugggcuucauugaguuccuugacacuuuuuucgggaagaaaaaugccacucgcagucuuugcuucugccuucacucguuguacaagaacccggucaaguaaaggagcaagggacuugauugauuugaguguugaagccauguuagaggauaacggacagugaauuauaaagacugugcaauaaaauugguuuaagagaaaagaucuuugaagucgcguuacguuaaagucgcuaucuguu

SEQ ID NO: 989 - RNA, 398 nt, Artificial Sequence
  Synthetic
uacuaacaaacuguccaccaaaaguauauauaauuccugcaacugagggaguagaucgcuugcaaauaaaaucaaaaucuagcauuccuugaacagcucuaggcugaagaccauagacgaaacaucuuguuuuaucauggaagaguguaugaguugcgugagggcucaaugggcggcuaggagcagcaaaccgacagauguuaucauuggcugauugcccaacuuucguaguaucauuuggaguagcugauggcauuuuaaaauauuacaaggucacagaguguaauuuugggccugauuucuucuguagagaugacucaaguaguaauauuuaucucuuucaaugguguaguauauuaauaguauacucgggagagaaaaugaugugauaaaaauua

SEQ ID NO: 990 - RNA, 380 nt, Artificial Sequence
  Synthetic
uuggcagcucgccauuucuuaucaaagagauaccuaaaugauaaacuuaaaauacuugcagugaauauaucugcuagaguaagacgcucuccaacuaagaauguguuguuuugaagaguauccucaaaaauuugagcauaaucgauuguuuuuuugacaccuucaucauaaaccuuuuuauuguaugcgacaauaccaaaaaaaggauaaagccagcuggcauagcaguuacuaauaucuugauugacaaaagacauccacuuuaaaauagaggcauaagucuaauuaugaaaguccacacggaguguuaagacagggacuguuuuaugucaaggaaaauuuuucaacugagagagcuuagcauacuccugcuugguuuu

SEQ ID NO: 991 - RNA, 369 nt, Artificial Sequence
  Synthetic
gucucauaucacgaacagcgaagcgaccuaauggaggauaacuugaaaaugacucaacacacauagguuuagauggaaucauuuuaacaauugcugcgucaccagauuuaacaaauuuuggaguugccucaauagacuuuccaguacgacgaucaauuuuuucaagaaguucugcaaauuugcaagcaaugugagccguaugacaaucaaguacaggugcguaaccagcuccaauuugaccugggugguuuaacacgauaacuugugcgguaaaaugcucggcacccuuaggggggucauucuuagaaucaccacaaacauuaccacgacggauuucuuucaccgaaacguucuuuacauugaagccaa

SEQ ID NO: 992 - RNA, 395 nt, Artificial Sequence
  Synthetic
aaaacaaagccgaccuuacgaaacaauuaggagagcuuaaaacagaacucggucaauuacggacucagaagauugcuggagguucugcuucaaaguuaacgaaaauucacgacauaagaaaaucaauugcaagaguucucacaauaauaaacucaaaacaacguucacaacuucgauuauuuuauaaaggcaaaaaauaccuaccucuugaccuccguccaaagcaaacacgagcgauucggagacgucuuacgaagcaugaaaguuccaaaauuuuagacaaaacggccaaaaggcucacccacuucccccagagaaaauuugccauuaaggcugagguuuagaaucaagauaaggaaugauuuaucuuaauagagauuaauaaaaaaauuaua

SEQ ID NO: 993 - RNA, 386 nt, Artificial Sequence
  Synthetic
gguguggcauagcugcaaucauuauuuacauugauuuucacaguuuuucaauugaguucaauaagauauaugaagacagagaaucaugccgaauaaagauugcucgaacaguuucuuguugcuaauauguuacucuauuuauuuuaacauaguugcguauaugaucaguauauuuacucaagacuuaauaagaguuuaguuucacauuuauugagcgguucguuuuccuuucgcguucuucuuagggguaucggcgaugacuaaauuuggagguaacgauugcuuuaauuuuucaacuuucucagagucuuuuaacacaagaguguauaaguauuucugacagcgaacuuugaauuuugucugagaagauuuuuuguuucguuuga

SEQ ID NO: 994 - RNA, 398 nt, Artificial Sequence
  Synthetic
cuacagcagagcguguuucgaaggaauuuccgaacauugaguuugaugcagaacuucucgauaauacuugcuugaagauuguuaccgaucccacccccuauaaugacaaaguccuuguuaugccuaaucuauacggagauauucucucugacaugugugccggcuuaauugguggacuuggucucacuccuucagggaauauuggcgacaaauguucaauuuucgaagcuguucaugggucagcaccugauauagcggguaaagcacuugcaaauccuacugcucuccuacucucauccauuaugauguuaagacauauggagcuggaaagcuacgcacaaaaaaucgagaaggcuauauuuaaaacccuugcugaagguaaaucacuaacgggugau

SEQ ID NO: 995 - skipped

SEQ ID NO: 996 - RNA, 398 nt, Artificial Sequence
  Synthetic
ggaaaaugugaguugccgccaucgauaauuaugucuccuugaucgaggaauggcaauaauguuucaauaaaaucaucaacaggcuuuccagccaugacaagcagcauaauacgacgugguuuuuuuaguuuacucacaaauuccuggauagaacgagcaccuucaauagauuucccuuuugccucauuuucaagaaaguggucuaccuuagcuacaguucgauuauaugcaauaacauuaaauccauggucugcagcauucagaauuagauucugccccaugacagcuagaccgauaaggccaaagucuccuguagcagcacucauauuuuuuugauuauaaauuuagaagcccaaagacuggagcuuauauggagaacagagauuacacagauggga

SEQ ID NO: 997 - RNA, 388 nt, Artificial Sequence
  Synthetic
caacauggcugcauacggugaagacucaucgcgaucugccuuaacuuucauucccccaguuacacgaguuauagucucacgaccggagagauccguuauguguacaaauguaucauugaagcuggcaaauauucgugccguugcaaagacauuugauucaccuucucggagcugagguccgagagauauauuuuccugagcaggucgagaagucuuuuugggagccauguauguuaugaguugcuggugcgaauaaguuguacguuucuuaacugagaagacccgauaucaauauuucaaucauucaaccaccacaacuauuaauuggcagugguauuuuacuacuaucagauguuucugaugagauggccuagaaauucaugaccca

SEQ ID NO: 998 - RNA, 393 nt, Artificial Sequence
  Synthetic
gucggguccauaaaucauaaugggacuaagagcaggacaaaugcuagacaacuccacaaaaagccuauaauucacauaaccacaccagaauuacuugcaauacgcggccauaguucugccgccuccuuuccuacaggcccaguuauagcagauccuuucauuucucccuuuggauugacaaucacuccugcguugucuucaaaauacaagaaaacaccaucuguacgucuccauggcuuacuuugucgcacaauuacugcuggcauaaccuucuugcggagaucuggcuuucccuuuuuuaccguugccauuaccauaucuccuacaccuccugcugguagacgguuuaagcgcgcaccaauuccuuuuacugagauaauauacaaauuucuu

SEQ ID NO: 999 - RNA, 398 nt, Artificial Sequence
  Synthetic
uagcaacgggacguccacuuuguacucuuacagcuucacguguauuaucaaucacugauugaugguacucaugagagccaugagaaaaauucauacggacaacauucagaccagcucuucgaaguccauuuaaggccucgacauuguuaguuuuggggccaauaguacagauaaucgagguucgacgauaauucuuagagguggcauacucagugucaaguugugauagccauucaaugcgaguagagcugguuaggugauucauagcugaaaccauauuuugaucuaaugagaacuuuuauuugaugugaacguaaauaguugaggauguguaaaguugaggagagaguuggccaaagauacucuuugaggguagcaaauuucguuuaucuuauuau

SEQ ID NO: 1000 - RNA, 397 nt, Artificial Sequence
  Synthetic
uuuuaaagcuauguauccucaaguaacagaauuagaaaaccuaguuuucaaauugagauuuuggaaaaaaucuaacaaccacuucacuuggcuccaucaauuuuggaaauauaacuuaggagaucuaaaacacggcgagaguaaccccauucauuaucauaccaugauacgaguuugacaaaguugucauugagcgagauuccagcuuucgcgucgaaaauggaugagugauuaucaccgauuaaaucaguugaaacgaugucauccucaguauaagaaaguaugccuuuuaauucaccauuggcagccuccuugauagcagccuuaauuuggucauaaguagcacccuuuccaaugcggcauguuaagucaacaacggaaacauuagcagugggua

SEQ ID NO: 1001 - RNA, 250 nt, Artificial Sequence
  Synthetic
ucaucuuuugccgcucuuuaucaugaucuugauaugggauuuacaccgaucaacuuuacauuuuacugggcaccucuaccuuggaaucgugcucgugaucaugcccaaagaacuguugcuaggacgaaccucgcuccaagggggcuuuaugggaaucugccucguaguauaaaguucugcagcuggcucuacggauugcaucuacaacaacuacaacaucaucaucaucaucaucuucaucuucaucuuc

SEQ ID NO: 1002 - skipped

SEQ ID NO: 1003 - RNA, 354 nt, Artificial Sequence
  Synthetic
gagaagagguccgugagaauuuugacucaucuuuugccgcucuuuaucaugaucuugauaugggauuuacaccgaucaacuuuacauuuuacugggcaccucuaccuuggaaucgugcucgugaucaugcccaaagaacuguugcuaggacuuauaugaauauaauccaagcucguacccuccucuuccccuuccccuucauugaaccucgcuccaagggggcuuuaugggaaucugccucguaguauaaaguucugcagcuggcucuacggauugcaucuacaacaacuacaacaucaucaucaucaucaucuucaucuucaucuucuccaccuucauaagcuucuacguuuu

SEQ ID NO: 1004 - RNA, 401 nt, Artificial Sequence
  Synthetic
augccuuacaaggagaagagguccgugagaauuuugacucaucuuuugccgcucuuuaucaugaucuugauaugggauuuacaccgaucaacuuuacauuuuacugggcaccucuaccuuggaaucgugcucgugaucaugcccaaagaacuguugcuaggacuuauaugaauauaauccaagcucguagagaagagaaaacgucaacaaccccccuccucuuccccuuccccuucauugaaccucgcuccaagggggcuuuaugggaaucugccucguaguauaaaguucugcagcuggcucuacggauugcaucuacaacaacuacaacaucaucaucaucaucaucuucaucuucaucuucuccaccuucauaagcuucuacguuuuugcauguucaa

SEQ ID NO: 1005 - RNA, 398 nt, Artificial Sequence
  Synthetic
caccaggauccaccuaaagaugagccaaccgaucagaagucucuggagcugaggagaaccuuauuuuauaguauuuacucucuugauagaucugucaguaugguucacgcgcgcucuuuuucauuuaccgacgauucgacuagcguuacuuucccauccauuaagaacgagaaauuaccagucgacaccaaauuaaaacuagguaggaaauucaagauucaauccucacuuuuauucaaacuucgaaagauucagucuucaugguaucacgagcuuuuucaauccaaaaaugauuuuauaacaaauccaucaacauauauucagaaagugugucaagaaaugcaagcaugggcucagucgauucccgaauauuuacccacucauaucaaaaauuauuu

SEQ ID NO: 1006 - RNA, 388 nt, Artificial Sequence
  Synthetic
guaucaaccauugccucuccaaaccuuucaccaacaacuuccuuuucaucuuuuguacgaacagaaacgccugauuccagucugccauuuauagaaaauccaguggcuagacaaaaugcacauuguaguaguaagaguguuggcaauggaaauggaauuuuuaacuuggacaugaaucuuuuggcuucugcugcuauuaggguggaagggaaucacucaucaaacgcuugucaucucccccgauacaauaaaucaugcugcgaccucagugcguacaagagucguucucauuuugccucaucaucacuuguucagucucauccaccuccgacauuagacaagcucaaucauugcauuaagagguauaugaagcguucacgaacugacu

SEQ ID NO: 1007 - RNA, 327 nt, Artificial Sequence
  Synthetic
caacagggaccaguuacccuacaccuacuggagguuacucugaagagcccuaccacuauaaaggugucaagcuaggucauugagaggauugaguuacgaaauuugauugcagccacgccuucgacuucaaccgagaagaguuccaaucucccucuuagacgcaggacuacucucacgauacuucugucucuacuucuucucaugagcacgcuaauacucucuaagccuccguugauguguugaaagacaggcaccucaguuuugauucuauucagcucggcaaacauguuguguacauucauagacugaauuucuuuuuuauuauuu

SEQ ID NO: 1008 - RNA, 250 nt, Artificial Sequence
  Synthetic
ucugaagagcccuaccacuauaaaggugucaagcuaggucauugagaggauugaguuacgaaauuugauugcagccacgccuucgacuucaaccgagaagaguuccaaucucccucuuagacgcaggacuacucucacgauacuucugucucuacuucuucucaugagcacgcuaauacucucuaagccuccguugauguguugaaagacaggcaccucaguuuugauucuauucagcucggcaaacaug

SEQ ID NO: 1009 - RNA, 300 nt, Artificial Sequence
  Synthetic
uuacccuacaccuacuggagguuacucugaagagcccuaccacuauaaaggugucaagcuaggucauugagaggauugaguuacgaaauuugauugcagccacgccuucgacuucaaccgagaagaguuccaaucucccucuuagacgcaggacuacucucacgauacuucugucucuacuucuucucaugagcacgcuaauacucucuaagccuccguugauguguugaaagacaggcaccucaguuuugauucuauucagcucggcaaacauguuguguacauucauagacugaauuu

SEQ ID NO: 1010 - RNA, 350 nt, Artificial Sequence
  Synthetic
guuacgcaucgccaacagggaccaguuacccuacaccuacuggagguuacucugaagagcccuaccacuauaaaggugucaagcuaggucauugagaggauugaguuacgaaauuugauugcagccacgccuucgacuucaaccgagaagaguuccaaucucccucuuagacgcaggacuacucucacgauacuucugucucuacuucuucucaugagcacgcuaauacucucuaagccuccguugauguguugaaagacaggcaccucaguuuugauucuauucagcucggcaaacauguuguguacauucauagacugaauuucuuuuuuauuauuuuuuuccaaaua

SEQ ID NO: 1011 - RNA, 398 nt, Artificial Sequence
  Synthetic
auugauccagaaucaggaagaaauguuaaaaucaggacguuuggauaaaaaauaugauggaauuuuagauugcuuuaagcgaguuacggcaaaugaagguguugcuucgcuauggcgugggaacacagccaaugugauccgauauuuuccuacccaagcuuugaauuucgcuuuccgagacacuuacaaaucaauguucaauuucaaaaaggaccgugauggauaugcgaaguggauggcugguaaucuugccucugguggagcugccggugcuacuucucuucuuuuugucuacucauuagauuaugcucguacuagauuagcaaaugauaacaaaagcgcgaaaucgggaggugagcgccaauucaacgguuuaguggauguauacaaaaagacac

SEQ ID NO: 1012 - RNA, 398 nt, Artificial Sequence
  Synthetic
aagacggauggcuaaagagaucuuaauuuaucgucccguugcugugauauagacuauucugauugauuuacuucucgucagauauaugccuuuuauaauuuauugcuucggaaaucuugagagguaauagacgcgauugaggggagguucuuuuacauagugaauaugucaagaaaaagaauagaucaagaauuuauuccuucuuugcuuuuuaauauuuuugggguuuguuuuaacuccuuuuucuuuagauauuaauuauggcuuuucuaguaauuuuucugcaucgacgaaaaaugauuggagaugagaaagggaaguagaaagaugcgaagugcuguaaguucguauucuggguagaguggaaaugcgaaagcaggcaaugaauuuauuaaaua

SEQ ID NO: 1013-1015 - skipped (3 entries)

SEQ ID NO: 1016 - RNA, 398 nt, Artificial Sequence
  Synthetic
cgucgaccucaaaagcagagaaguugggcgaguugauuauugcuucuacggagaaagccuguauaacuguagguucguagcuuugagcauucaaaaauuuguuguaaacgauuuuaguagaugaguauucacuuggcaaaugagagauuugaucugcuauuguuugagcgucugcaaagguuggaauaucuuucccuacgccagagaaacuuaaaacaauauuuuuacuacuugaccgacucaauugugccuuagccuucucucccaauaccacaauaucggcauugggguuuucagagagcauuuuucgaacguguuuacuuaagccugaaugaauaccgccgcacaauccuuuaucugagcuugcaacuacaaucaaguacuuuuggucaucuuuu

SEQ ID NO: 1017 - RNA, 398 nt, Artificial Sequence
  Synthetic
cuucucgguaauuccgcaacauuuuuaaccaugacauuccauuucguacaugcucuugauauuccgauaacgucagccucuugaaaugcaucacuuccuauggcaguagugggcacuuggccgcaaaaaacuacuagugguguaccgucagauagagcguccugcaucgguguuaugacauuuguugcaccagggccagaaguaacuagaaucaccccaggaaguccacuagcucuggcauagccuucagccauauguccagcacccuguucauguuucgguagaauaaaaucgaagugccuugaauuauaaauagcgucgaaaacgggaagaauugcuccaccaggauaaccgaaaauauguuuuacaccuugccguaacaucauuucgugaaauau

SEQ ID NO: 1018 - RNA, 398 nt, Artificial Sequence
  Synthetic
cugcugguagugacaagggcacagaacacgucugggaaauaagccagagcgugggcaugauaauugguggaauuuuagaaaauuugcucaugcuuaugggaaaaguucccagcuuaacgaggaggcaaguacgauauagcuguaugacaagauacuaugacuguaguaaagcuaagaggcuacuuggauauacaccagaaguccaccugugggaaggcauagagaggucaguugcuugguucaaaaaucagaguuaauuaucgaagcccgaaugaauacuucauauuacuaaacuugcccgaauuaaaauucuggcuagcuuaguuaucaaauaaaaauugauaguuaaguugaucuuucauugaugaauauauaaguacuuaaccuuaucauucaau

SEQ ID NO: 1019 - RNA, 398 nt, Artificial Sequence
  Synthetic
aucgugaauggagcuguaacugaaacaacagcuuuacuaaacgaaaaaugggacaaaauauuuuacacuggcaauacccaaguagguguaauaauugccaaaaaagcugcagaaacucuuacaccaguuugcuuagagcucgggggaaucaauccggcaaucauuacgaaaaaugcagacccauaccuugcugcucgucggcuauuaugggguaaacuaaugaaugcuggacaaguuugcaucagucaaaauuauauucuugucgaacaagaaguuuuaccaauuuucguagagcauuugaaaaacacucuaaaugaauucuauccaaaugguauaagaaauaguccagauuuuggaaggauagucaaucagcgucauuuuucuagaauuaaaaaaau

SEQ ID NO: 1020 - RNA, 397 nt, Artificial Sequence
  Synthetic
cgagguucaugguaguucccuaucuaaggaugaucuucgagauuugagaaauauugaccucucagacuuuuccuaccgacagcccuauaugcaagaaagaagagacgccguuggccaaagaggaaacauaaguaauagaggaagaggaagggugagagguauaggaagggauccaaacguggaccuuccccaacccuuaaguagucaaccuuuaaggagggacgaacaagcauuucaaaggcaacuagcaguccaauccucucagucugucacgacaaggaacuccguccaucaaaauacaacaccagcaucgcaaauaucaaauaauacuccaaaaucacagucucaaguaacaagauccccccagacuucuaauaaccuugaaagugcaaacauu

SEQ ID NO: 1021-1022 - skipped (2 entries)

SEQ ID NO: 1023 - RNA, 374 nt, Artificial Sequence
  Synthetic
caggacuguccaguuagaucuagagucaaaaugcccaaaucauccaaaaaguaaggugguauaagaagaagcuuaacguuuauagacguaacugaaucucggaagaacagcucuuuccuagcaagcaaguaguugugaaauuaccugcuccuagguuuauuuuuuauuuucagguggaauauugaugaucgcuggauccacaaaauguaaauuaaaaaaauaaaaacaaauaucuggugacugaaggauuucauguagugacuaaacgucaguacaagucacagaguacugaucaaaacuacagaauuauaucucgacgucuucccugaagaugauaaaagauucacccacaacauaaagcuuucauuauauau

SEQ ID NO: 1024 - skipped

SEQ ID NO: 1025 - RNA, 384 nt, Artificial Sequence
  Synthetic
guguugagaccuaagagccuaugagugagucacauuacaacagaaagccucaagucuaaagucauaaccuauuaaaauucgaaagcacaaaaacauccauuaggaacugacuaaguacaagagcuacuccauaaaaaucagucgcaauacauguuuuugcaaagcagaucaaccugguuaagacgagaaauaacuuaguauucaacguagcuaaaucuccaggguguuaguguaguauauugacguuuccgaaauaauuaaaaccagcaucuuaguuugguguuauuugauauauaugauaagauucguuuaggauuuauuggaauuuauuuggcugguaucuaauguagauuugauugauaccguauuaucaaaucauuuuau

SEQ ID NO: 1026 - RNA, 392 nt, Artificial Sequence
  Synthetic
uuaucaugcugccaugguucauaagaaaaaaauuuacuaagauuaguagggaugcauagaccuaaugacacgcccauaaaaguuguauggcuaucccaaccauguucagaaaguaucucgagaccaugaaugcuucuagaaauaaggccaaguacgaaaaaugcgguuccucucaugcucauuauuucaugcgauucugcaauuuuaauuauguucugcacgacaucugauuuuucaagaaaaggagcacccaauuccauagauccaacguuaccuacagcccauaggcauccuuuaaccuuaagaauaaucucuaaaucaucauaaugcauuccauauucacgaaugguugaggcaaauucaucaaaaugaccuuuaucaugcaagagcuu

SEQ ID NO: 1027 - RNA, 394 nt, Artificial Sequence
  Synthetic
uugcaauaucuaguaaaacucuuuuaagucgaauagauaagaaguauuggcucuauuugaaaagugaucgaaaucaagaugaaaagcugagauuccucaugacuuuagauaaagaauuaccuaaacaucuucuuuguuucuccugugcaauauaucauugucggcuuaauauuggaaaagaacgccuuaaauaugcaugggucccgaauccugucuacaauugcaauggaucuaaaaaauuugggcugcagcagcccaagauuagauuaacacacggucauuuucuuccuuuugcauuuguacagcuugcaaccagagccgaaaaguacacuauucaacacgguaucccauuaauuaauuugugucgucguuacaaagaccguaauaccgauug

SEQ ID NO: 1028 - RNA, 344 nt, Artificial Sequence
  Synthetic
uuggacaagggaucgacugcuaagcaagcaucaagaacagcaucugaaaccugaucagcuaucuuaucaggauguccuucucccacagauucggaagugaaaagaaaaguuccagaguuuugagccggcauagcugcaauagggcaaaaauuuaagucuaauuaguguaugaaaagugaggagacgccuugaagaaaaauauauucuguaaaagacuugaaaaugaaagucgagauuugaaugagggguaaagcagaaacuagagcuauuuagcugccuugaggaauaaaaacuaagcggagaugcucuaaaaauaggcagaacgauauuuguggacuggccau

SEQ ID NO: 1029 - RNA, 398 nt, Artificial Sequence
  Synthetic
aggcguggacuguagccucaauagcauacacugaaucgaaugaguugucaggaaaugacauuugcauaaagucacccuuaacaaagcuuaauugguuugauaagccuucuuucugugcauaucucguggcccgcucuauuugguaaucauuguuguucaagccaguaauaugagcgccaguaaacuuggcgauuucucuugccggaccaccaacaccacauccgacaucaaguacuuugucugccucauuaaugccuaucuuagcggcaagauaauguucaugucgcgcaaucgcuugguaaaaugguucaccguaagcaaaucuacagaagugaaaagauuguccccagccguauucguaaagaucggugccgagauuauaguacugucuugucaaa

SEQ ID NO: 1030 - RNA, 396 nt, Artificial Sequence
  Synthetic
caaacucgcucaauucuccguaugacuaauuguucuuauacuuauccuggcgcuucaaaaccgucuuugcacaaugugucuugucaacucucccuuucaucucgaacugcaaucauaggugguaauggugcaggaaaaucaacguuaauaaaacuacuuacuggcgagacggucccuacuucugggcgagucgaaaaacacccuaauuugcgaauuggauauauaaaacaacaugcacuugaacauguugaaaugcaucucgagaaaaccccaaaccaauaucuucaauggcgcuaugccaauggugaugaucgugagguacauaugaaacagacucguauuuuaucggaugcugauaaagcucaaauggaaaaauggauugauaucgaugggaag

SEQ ID NO: 1031 - RNA, 398 nt, Artificial Sequence
  Synthetic
cgcuccaaaaucguccuacaaaaaaucuugaagaaaaaauuacaccaguuuuaccuaagauuauuagugaacauuggaagucugacucaaaucaucccgcaucaccuucacaauucuccaacaugacuuacgaagaaaaggaacgagaacgaaauguuuguagugcagcaaaggacuuagaacgaccuccaucuaucaaugagccauccucagauuauaaccgugugcgaucuagugaaagacaaggaguucuccgacaauucuuuggugcuagacccccaagugaauuaauuacaucagauuuaaccacauauuucccugaucauccuagagaagaaauugaccgaacugcucgacuuucaauacggagaucaacucgccucaguaaaguuaauagu

SEQ ID NO: 1032 - RNA, 386 nt, Artificial Sequence
  Synthetic
uucgcuguaacccuccuaguauuuauuucugcccaaguuuucuuccgaaaaaucuaaaaucugagagauuuuuucuuuaauuacgaaaaccagaguuaggauuuaaugauuuuaaagauaucaacaucucacuuuaauccccucucuuccaaaugcccugacucaaccaaaauguuaaccauuaaaaucaaaaucaaaaauucaagcccaaauuuaguauccguaaagaaaugaaaguuaaaugaauugaacugaacaaaaauuuuuggaauauuaauacgccaacuuauauaaaagcguaauuaagagaauuuuugccggacacucauauuuugauguucuguuuaacuaguauugcaacacuguuguuucucuuaagccacuua

SEQ ID NO: 1033 - skipped

SEQ ID NO: 1034 - RNA, 398 nt, Artificial Sequence
  Synthetic
ucagugagaguguuucguagagaauaggcauaggauucuaauccauucuuagcaguaauccugccugcuucagcuucaucaucagccuuauauuuuucagcuucggacaacauucucucaauauccuccuuggaaagacguccuuuaucguuuguaaugacaaucuuguuagauuuuccaguucccuuuucaagggcugauacauucauaauuccguuugcauccaagucaaauguaaccucuauuugagguacaccacguggggcagguggaauuccaguuaacucaaauuuaccaaguagauuguugucuuuuguucguugucgcucacccucaaaaacuugaaugagaacaccagguugauugucagaguaaguugaaaauacuucagacuucuu

SEQ ID NO: 1035-1036 - skipped (2 entries)

SEQ ID NO: 1037 - RNA, 357 nt, Artificial Sequence
  Synthetic
cuacuuguuccaguaacgcuuuucuaucuuauuuuacgaggucuagacacaaucgaagaugauaugacaauaccaauugaaaaaaaggagccauuacuaaggaacuuccaugauguaauugggaaaaaagaauggaauuuugaugggaacgggcccuuagaaaaggauagagaacuucuuguucacuuugauguuguuacaaucgaauucgcauugaucaaaccuguauaccaaaccauuauuaaggacauuacagagaaaaugggaaauggaauggcugauuaugcuuuaaauucagagcaaaaugccaacgguauaaauacaaucaaagacuaugaacuauauugucauuauguu

SEQ ID NO: 1038 - skipped

SEQ ID NO: 1039 - RNA, 398 nt, Artificial Sequence
  Synthetic
auaaaagacuaauaugaucuaauuuaaaucgaacugauugaaaaacauuugauuugcaaugaaaauuaauauauaaucaaauaaaaucaaauauuucucacucuggugccggcccguugugguaggaagugacccaacucuuaaaucaggucagcaacauucauaggcaucucuucaauuugagugcuauaaaacugcucaauuucacgcaucauccgaacaucaucagcuguuacaaaguugaucgcaacaccuuuucguccaaaucgaccaccucgaccaauucugugaauauaauucucacgauuagcaggcaagucguaauuaauaacuaaugaaacuuguuguacaucaauaccacgagcaagaagaucaguggcaauuaaaacacgggauga

SEQ ID NO: 1040 - RNA, 398 nt, Artificial Sequence
  Synthetic
uaucugcaugugcuagauauaugauuuuugcagcuucauugacuccgucaaguagacuuagugugccagaugcaagauccaacuuuuccaacucagccuuggcaguuugucguccuuuaccaguagcagcaccauaguaaccccaauaugauccacuuggcucaaucauaaauaguccuggaccaccauaggucuuacccucagcuuuuccgccugagccaaucucuggaccacuuccaacuucgcuaucaacaggaauuucagauucugagucccauccagcgauuauagcugugauaccaaacggccuaacagaagaguaaaggguguacaauugcaaguauugacccauucgauuagcuaaaucagcaguagagaugggacuuuuauagauuugu

SEQ ID NO: 1041 - RNA, 398 nt, Artificial Sequence
  Synthetic
uugaguacagaguaguaguaaucuauuuacaugaauuacaagcuuguacggaugaauguuugucauaagccuacucaucuuucauggcgaauuucccaggcggcuaacuacucuaauuugugagaggcaugaaaguaaugauagauuuucucuauguauaauaaauaguacucguauuuuaaucauucaaacccuagugauaucuuuuguacucuucucuuaucaaauuacaucaaguucauuccgucauuucucguuauauaugacauauaaagcauuccauucgcaugauagaaaauaaguaauauguauaaugacucaaagccuucaccccauagccaaaaaguuggguuuauagugaaacuugugacguagaggggauuaauaucgcauuuucu

SEQ ID NO: 1042 - RNA, 398 nt, Artificial Sequence
  Synthetic
aaugauguaagcuccaugggaauucauaaccugagugagcaucaauagcuuggaauagucgacagauaauccaacaauacaucguaacuaagugaagauugccaguuaucagacaccauacaguuggcauuaagacuguuccugcgccaagaaccauuguuucuauuggugaagcauauucagcugcuaguccgaagggugcagaguaaugaugauguauuuuaugaauauguuuguagaaaggaccccaaugaaauaaucgaugcauccaauaaugccacguaucuuccaacacgaaaaagaaagcaaucugaagacacauaguuuuuaaugauggaaaugggacaccaacauccauaccacaagccuuugucaauggaugaaaaagccaaauuuga

SEQ ID NO: 1043 - RNA, 396 nt, Artificial Sequence
  Synthetic
uuuauuauggcacuggcgugaaaauaccuuaucccaaggcagauaccgauaaugcgagugcucauggauauacaaacauuaagggcgguaauccggaaggacgagcuuuucaccaugguagacuaauaucucagcuccguagaugcugcucccagaacccgaacaucaaaauuguugaaacgcugguuacagagacuauuacgaauccucaaacccaaacuguaauuggcguaaggucagagacaaugaaugauaaaacaggcaaaagagaagccgacuacuauuugggagaucucacaauuaucgccgauggauaugcaucuaaauuccgaaagcaguauauagacaagucacccaucguaaaaagcaaauucuaugcuuuagagcugauagauu

SEQ ID NO: 1044 - RNA, 397 nt, Artificial Sequence
  Synthetic
ugucaagcguauaacaguugacgaggcuuuacaacacccauauuuagaaccauaucaugauccagaagaugaaccaacagcccagccaauuccagaagaauucuucaacuuugacaaaaauaaagauaauuugacuaaggaacaacuuaaagaacuuauauaucaggaaaucaugcgauaguaggauauuuaaaauuugaacgagacacaaaagacagcccgaguugguaacaauauucuuaacaacucuuuuauuaccagagaaaguugaaggagucauauuuaauaaguuuuaagcacauggcuggccagauucaugucuuuagaaauugauucgagaagcuaaaauuuaccgguuauuaguucggcuagaguuggauauauuuaucaauauaua

SEQ ID NO: 1045 - RNA, 397 nt, Artificial Sequence
  Synthetic
auucuugucaucucagggucaaaaaaggauguuagcucaacaucagguaugcaagcuaccacaaaaacaucagagcuuuuuaaucgacguguggaaacugucgugccagcaaauaucaaaaugaugcaaagcgcaauuaugaacaaggacuuugaaaccuuugcuaaagucaccaugucagauagcaauaauuuucaugcaacuugucuugauacuuacccaccaauauuuuauaugaacgauauuucccgcgcgacgauaagauuaguugaauauuugaauugcauuuugaaccguacaguugcggccuauacuuuugaugcagguccaaacgcuguaauauauuaccaagaggaagacgagaaauuagucguuggacauguaaaaggaauccuag

SEQ ID NO: 1046 - RNA, 394 nt, Artificial Sequence
  Synthetic
guccgauuaaaguaucucucuacauuugagaauucuacagaccuaacuugggagaauacugauauacuuguauggucuauucucgaaaucgaaguuacugucauuugcgcaugcuuaccuacauuacguccacucuuuguugaaauaauuccuggagucuuccgaacagcuaagaauacaucaucaaguagcagaauuacuaauaguaauaguauauugaaaccuaaauuaacuaaauucacauuuaacuugaauccccggaacuggcucagguggaagaauaaacacaagacagaaucggaaaaauugccagucugcgaaaaaucauggaguucggugccggguuaaacaugggaguaacuuugaucagaucauaacacuaauuggauauuuu

SEQ ID NO: 1047 - RNA, 398 nt, Artificial Sequence
  Synthetic
cuagcacuuacgagcacgucucuuugaauucaacuagagacucacaauuauaccuuccuccuauuaaaucuuuaguauuggauacgaaaaaugagggaaguuauuaguguuaauguuggccaagcugggugccaaauagcaaacucuugcugggagcucuauugccuugagcaugguauacagccugaugguuacuuaacggagaagcgcaaggccgccgaaccugacgaagguuucagcacuuuuuuuucagagacuggucagggaaaauacguaccuagaacuauuuauugugaucuugaaccaaauguagucgaugaaguucguacggguacuuaucguagcuuauuccaccccgagcaaaugaucaccggaaaagaagaugcaucaaacaauua

SEQ ID NO: 1048 - RNA, 398 nt, Artificial Sequence
  Synthetic
gacuauuguccugacuaaacuauauaccaucugcuaacacgauccucaaagcaaaauuuuuaaccgaugaucauaagucauguaaaaguugaaauuucaacacacaccaagaaaaauagccuuggucuuucaauuuacagcauccauauggaugcuauuuucuuauauauuucaccuaccuccugagaacugcaucaagauucgaggucguuucuuuauauaaucaugucaaauaaugcaugauaaaugaguaagaggcucuaggcagucaaacucaaagaauugucuucaauuguauugucauuuuaucucauuugauaaugaguuguagccgcaacucaaaucauuuuucauuuuuugaaaaugaaguaaaagaccgguuuaaaaaauuaaauauc

SEQ ID NO: 1049 - RNA, 396 nt, Artificial Sequence
  Synthetic
gacacaggaacucagcacacaaccguugagcaagauaguguccgauucguuuaucaaccucuugacgagcuuuacaugguacuuguuacuaaucgucaaucuaauauccuucaggauauugauacccuccacguguucguacaaguuaucacaaguaucuguaagucucuagaggagagagaaauacugaaaaaugcguacgagcuuuuaagugcauuugacgagauugucucucaggguuaucgugagaaucuaacaaucaaccaaauuaaaucuuuuuuggaaauggaaagccacgaggaaaggauacaagaaauaauaucaaggaauaaagagcuagaggcuaccgaagaacgaaagagaaaagcuaagcaauuggaaauucaacggaaagag

SEQ ID NO: 1050 - RNA, 388 nt, Artificial Sequence
  Synthetic
guagaguugagcuuggcccuaauggcguaaauaagauccaugaagugggaaaccuugcuccugaagaacaaggucuuuuaaaagcugcucuaguugauuuguuaaagaauaucgaaaaaggaaucaaauuuguuaaccagaaccccggugaauaaauaaaauguuauucaauuuacaaucuguuguuuuuugaucguggauaccuugauauucaguaacgagggagaaucauucuccugucccaaaaaaguacuaucuacuaucuuaaauuuuauggaaucuugaauuuguccaauguaucaauagaaaaauucuuucaaauuacaagucaaaaguauuaugaaaauuaaaaaggacuaauccucuuacauagauauauauaaauaua

SEQ ID NO: 1051 - RNA, 398 nt, Artificial Sequence
  Synthetic
gugaguaucagguguauaaauaaaacguauaaaaaugugauguuauagaucgacggucaaagauuucuagagauugagguacuggacauuccuucuucaaccccucaagaaauuguuaagucgaaagauuaguaauucucaacucugauuaaaauaaucgauauguaugaagauaagcgagaugaauugauaauguugucuaaaauuucgaauuaugaaucuuuacaaaagagggugaguugucguaugauaaaaggagccugcuccgaucuagauagaacacagcagguaaaguagaagugauaucugcgaggagccuugacaccagcaaggacucaguccgaagaguacgaguugcuuucugguuuguugaaugaaagaaguagaaaaaaauauaa

SEQ ID NO: 1052 - RNA, 357 nt, Artificial Sequence
  Synthetic
aagaaacagacagaugauuuuaucauauuucaagguauauuugaauuuagugaaucuaguuuaauauaauuuaaauuuauucgauuaucaccaaccuaugaaaaaaucauuucaucccaauuccgacaugaauuuguagugucugacagguuuguuuaaaaacgaagugguguaaagaaccaucgauucuuuccacuuaaauaucucuccucuaaggcuuucuuaaccacuuucuuggcauccucucgcugcgauacuuccuugaauguuucuguagauauuacguuuuuaagaccuucuaauucgaguguguaacguguuggcauaauaugauuauaauugauaacuuuuauaaaa

SEQ ID NO: 1053 - RNA, 398 nt, Artificial Sequence
  Synthetic
uguagaggugaaguaggugaaaguugauuuggcgaugguagagaugaguuacuauuacugauagaagguaaauuugaguaagauugcaaauuucuaucagacgcagcugacugaucaagaguuugcucuaauaaggaucuuucaugagcugaaugcgcauaugucggugacaaauuuuugggaugaucgauaaagaauuuuuugguugaauaguugcgagagauuccagguuguauugcaggugaugaagaagcuggugaagaaauguugcuugaguugucaaaauugcuacuguuugaaccauuuguuuuugcggaaggauacgggagugguuuaccuucuuuugccauccgaaaaacuggaaguaaauccucucuaagucguguauauucgaaugu

SEQ ID NO: 1054 - RNA, 387 nt, Artificial Sequence
  Synthetic
cuucgcaggcugauugugcuauuuuaaucaucgcugcugguaacggugaauuugaagcugguauuucuaaggauggccagacacgagaacaugcacuccucgcauucacacuugguguuaagcagcucauuguugcgaucaacaaaauggacaccgcuaaaugggcugaagaucguuucaaagaaauuaucaaggaaacuacaaauuuuauuaagaaaguuggauauaacccaaaaucgguugcuuuuguaccaauuucuggcuucaacggugacaauaugauugaaccuucaucaaacugcccaugguacaaagguuggucaaaggaaacaaaagcuggcaguaguacuggaaagacacuucucgaagccauugacucuaucgacc

SEQ ID NO: 1055 - RNA, 398 nt, Artificial Sequence
  Synthetic
uccauauuuucaagacacucaaguuaauagcauagaaaauggugcuagccuuuuuaacaaagccuugguagauacgaaaaaugcagucggggcuaagccuguauggaucacagaaacgggcuggccagugagcgggaaaaaaucaggcuaugcagaaacaggagccacaaaugcuaagacuuauuggaaccaaguaggauguccuauuuucggggccgucaacacuuggugguuuacucucgaugauacagauaacagcuacccuaaucccaguuuugguauugucucuggcacaaaaccccuauuugaucuuaguugcucuaaaucuggaucuggaacuaucuccagcguuaauacugcuucaauaccagaaccaacgggagcaguuguaucuagug

SEQ ID NO: 1056 - RNA, 397 nt, Artificial Sequence
  Synthetic
aacucaaaaaagauugucgggaagucuuuccuaacguagaauaugcauauacgacaauaccaacauauccuucuggccaaaucggguuucuaguuugcagcaaagaucccgaacaagaccucaagguaccccuaagaucuuuuagugcugaagaagaagagaagcugcuucgcuacuauaacgcugauauucacaaagcaaguuucauuuuaccaacauuugcucgcacugcacugaaguaaggaaaacgggaauuccuaaguaaaguuacaacauaauuaucuuccaaaaucuuuaggauaugaaaaucucaagaugaaaauguuauuuacuacuuugauaauauuggcagaugauaaaacguuauuggacuugaaggauuuuuuaacaaguuuug

SEQ ID NO: 1057 - RNA, 350 nt, Artificial Sequence
  Synthetic
cugggugaguuuuucguaacgucgcuacuuuauuaacuugaucugccguggauuuugguugucuuguaucaaucaaaaggagaggaagcuucggaaacuucauuaaagaucuuaugauuggcuccuuugaauagucgggccucugaaauauaacagcuuuuccuugggaggcaacaguguuaucuacuccugaaggguuuccauggauacauauuucuccuacauaagcccacauauuaaugcggcuuauuuggguaugugcuucuucaauggguugguccucaugaggcccagaaagcgcucuuaccuguaauaagagcgcagcagcuagacacacaguaauagaugca

SEQ ID NO: 1058 - RNA, 391 nt, Artificial Sequence
  Synthetic
gaucuggucgugguuugccgaaaagauucuucauuccucccguuauaagaacggugagugauagugaaaagcuuaauccaagcaauccaacguguaauucccacauucuccgaugccauauggcagaucuaggcguugacuuuguaaccgucgguccaggaacaagaacuaagcaaauagcaaaaauaacuaaugccggaauuauaaaagcauauaauccaagccaucguaccgagacuuuuucauguguuuuauagggaaagcugauaucuggguucuccagcgagaagggucuuuuguuugguacccucgauccaacaaauaauccaaaaaaugcaccaaauauaacuaccagccaaucgacaacauaugaaaguacuaguuuuaauga

SEQ ID NO: 1059 - RNA, 394 nt, Artificial Sequence
  Synthetic
uugguacuauggccagggucaauucaauucaauuuuuuucuaucaaauaaaauuaaaucaaaauaguuuucaauccaaucuaacccaaucuuaaucuuaaaauguaacuucaaacauugugauucaaguacuaaucacacgagaaacuagcaacguuugaucucgcuuuucgaucuacuuuagguacuugaugaaauuuucaaagauauuuugucauaaaaccagucacuaagcuucuuugcuauauaauugcacuacgcgacgucaacagaugcucuuuucacacuccuaguuauuaaagcaauugaaacaucuucuaacuauauacaacuugaauauaacuccagauuugaauauauucuccaccaaaauuuaauuagguuugcaauaaauu

SEQ ID NO: 1060 - RNA, 398 nt, Artificial Sequence
  Synthetic
uugagaacaugaccgaggcuacucuaaucuuagauauguuucucaacaacgagggagccuuuaacuauccucacauuuccuuucgcaaaaauuuccacccuuucaacuucucuaaaaacaauugauuugcuuagaccauaagaauauuucaauaugauuaaaacugaagcuaauggugaaggauuugauauuucuauuccagagguaucaguaacugaggaacgaaagccauuugugcaaaaggaaggauaucucaaauuaaagcaagcaggaacugcaagagcgaaugaagccgcuucauacgaagcuccacguggcacuguaaaaggagauuacgcauaccgucaucgacaucagacaguacuccaacagcauauagccuuuuuugaucaugauaa

SEQ ID NO: 1061 - RNA, 313 nt, Artificial Sequence
  Synthetic
cagugcucucgcagcaggccauuuagucaagagccauauggcacauaacagaagugcuccuauuacaagaaguaauacaccugcucagauuagcacacacccaucaaugauaucaacaaauagcaugagagaaaaauauugagauuugaaauucuaauuguguaaaugagcucagcuauauugaaaauaaauugguaaucuaauauagagguagaacuaguucgauuuuuauacucauuaaaaaaaggaacuaauauugguaaaggguuaagcuaugaaauuagcuauccuuuuuuuuccuauuuauugaaaa

SEQ ID NO: 1062 - RNA, 396 nt, Artificial Sequence
  Synthetic
aauaagugucuggauuguugaaugggauucuuuuuagucgaucaauuucaauuaacucauaacgcagaaauuucuuaaaauugaacgauuuauaggaaccgaugugaaauuuucuucaaucuccaugucaaucgcagaugugggcaaaaaagauugggaagagaauucuuaguuauauuucauuugaauacuauugggguaaugcauguccaaagagucucguaccaagagauaccuuuaucuggaaauaauuagaagauuuacccgucuuaccuugaugaauuguguguuagagauacaccauggcuaagauauuaauaucuauuuaguuugggaaguugaugacgauacaucacaguucucuguaaauuuuguuauuuccucuaauaucauuaa

SEQ ID NO: 1063 - RNA, 400 nt, Artificial Sequence
  Synthetic
uacccgucugcaacagguacaggugguuacgcaucgccaacagggaccaguuacccuacaccuacuggagguuacucugaagagcccuaccacuauaaaggugucaagcuaggucauugagaggauugaguuacgaaauuugauugcagccacgccuucgacuucaaccgagaagaguuccaaucucccucuuagacgcaggacuacucucacgauacuucugucucuacuucuucucaugagcacgcuaauacucucuaagccuccguugauguguugaaagacaggcaccucaguuuugauucuauucagcucggcaaacauguuguguacauucauagacugaauuucuuuuuuauuauuuuuuuccaaauacacucuuccuggaaaaagaagcccu

SEQ ID NO: 1064 - RNA, 398 nt, Artificial Sequence
  Synthetic
gaagaccaagcuagagcgaguacaaaaacaucccgcaacauaucaaugucaucuuugccccaaaaaauuuacucgcgccuauaaucuucgcucccaucuccgaacgcauacaaacgagcgaccuuuuaucuguuccaagugcacaaaagcuuuugcgcgucagcaugaucgaaaacgacaugagagccuacauucaggugaaaaaagauuuauuuguagaggagaacuuaaaaaugguggucauuggggcuguggccgucccuuugcucgugcagaugccuuaaaucgacauuuccgaucggaagcaggccgagcuugcauaaauccacucauagaggaagacgaaucugaaaaucuacggcuauggaaugagaaacaaauucaaaauauuaaacaaa

SEQ ID NO: 1065 - RNA, 380 nt, Artificial Sequence
  Synthetic
acccgcagguacucuuaugcuuggagcugaagguauuaaagaugccauaacuggcuucgaagaugcucguaaaguagauuuaaagaaugaaagauugccuccaagucuugaggaaauuacacgaacaagugaagaggauagagcucuggcauuagagagggcuaaggaaagugcggauaaugaucgagggcuucagauuuuaucuagaagacucaguuuaguuggcacucaaccaaauagaccgcaaccgaguaaaauucugaacucuguucuagcccucgauaaagauguuucugagaaauaagaggucgaucagagucaccuccuguuacaagcucauugguuggucugcagguacagaauuacuaaucauaccacga

SEQ ID NO: 1066 - RNA, 397 nt, Artificial Sequence
  Synthetic
caacagcuugaauugcacggaauuaucacuaucaucccgacuaagccucucaaaaagcaaaauuuauuugcuagcucggaaaagauaacagcuagcuacgcaaaagcuauucaagaugguuguuggcauucauuuucgccaaacucucagaaaagcugcaacaaauccccgucauauagaaaacaacucuaaucagccagaaacuauguuguccggagaaaauauuggguuacuuacggggcgaacaucaaacgcccgcaaaagugcguggcgacaaauuuacgauguacucggaagcaaacauuauucagccggaaaagauagugauaguaaaauuguacgagcuauagcgccaacuauucagauuacaaaaauuacguuauacaguaauuauguc

SEQ ID NO: 1067 - RNA, 390 nt, Artificial Sequence
  Synthetic
gaagauacaaauuuaugcgcuauucaugcuaaacguguuacuauaaugcaaaaagacauucagcuugcaaggcgaaucagagggguuuggggugguuuaggcuagcuuuuuuauucuaaauauaccagugcccgaauuugaucucccuaagccacaccaucgaguugaaaugaugagaggaagaugacgagaauaaaauuauugugaauauucguuauauggauaagcguagaggggaucuaauacuugugaauugguaaucuugaguuaucacuuuuucuggcgcauccagcgacccuaagcauauggacacuagugauugcgucuuaggguuauaguagccaagaggaauuugaagcacacauauuagcacagcauaauaauaaauaa

SEQ ID NO: 1068 - RNA, 393 nt, Artificial Sequence
  Synthetic
uccggugccauuuccccuggugaaaucaccuccuugcaacaugaauugaggaauaauacgauggaaagcagagcccuuguauccaaaccccuuuucaccaguacagagagcacggaaauuuucaacaguaagcggaacaucuugcugaaauagauugaauuugauagucccagauuguuuuucaaucuuagcaguuggucgaccagccuggucgagaacuggucccucccaauuaacuuugaagaacguuuugaccgacauauuuguuguugaacaguggaaauuucugacaggaaaugaaaauuuaauuuuggaugguaacaugaaugagaacuggcgggguaucauuuugaaguugagaauacgcuagcucggaauaggcaagcgagauga

SEQ ID NO: 1069 - RNA, 391 nt, Artificial Sequence
  Synthetic
uucuacacuuggcauuuuccuuacaauugcguucugcuuugccauucuaugaacuccaagugcuaaaguuacaguuacaauuauagguaagccuucuggaauagcagcaacugcuaaagauauagaaacaguaaacacuucuaaaaggccuuuuccuugaaaccauccaaucauagaaauaauagcaauuaucaaaaaagaugcuuggcuuaaaugugauccaagggaguccauggaaagcugaagggguguucuagggcuuucugucuuuguuacagcugcagcuauugaaccaaagugaguauuuucaccagucgcauacacaauaccuugcccauagccagaccgcacuaauguucccauaaaagcaauauuuguuaaauuacuugaa

SEQ ID NO: 1070 - RNA, 396 nt, Artificial Sequence
  Synthetic
ucagugagcuucucaccgauagaagucauuacauagcggaguucagcagcagagauaaagccauuauuaucacgaucaaagaccuugaaugccucucguauuucuuccucugaaucugugucuuucauuuuucgagccaucauagugagaaauucuggaaaaucaaugguaccauuauugucagcgucaaccucauuuaucauauccugaaguucugacucggauggauucuguccaagggaucgcauaacagucccuaguucuuuuguaguuauuuguccaucuccaucuuuaucaaauaaagaaaaggcuucuuugaacucagauaccugcucuucuguaagagaaucagccauaauugcaagaaauugaacaagauaagaauuuaagcgugau

SEQ ID NO: 1071 - RNA, 377 nt, Artificial Sequence
  Synthetic
auauuucuagcagaauaauaaaaauccauagcaaaaaaaaucaacaaaggcaaacauccaucaacucuaguggaggucuacucguaugugcauagauaggcuuuucgugcuccaugggaauugguucacaauuaucaccuguuguauccucuacauuuaucgcagguaaguuugggcuaccaccauguuccucgggccuauaaauaguuguacaacuuguacuucgaguucgauauccaguuuccccacgaucacuaaugggacuaucugggaagcagcuuuuauuuccgucgcguauauuuuucaaugcuuuugcaagaucuucagccaccacuugcuuguuaggagcauccucuagccuauuuucccacccauga

SEQ ID NO: 1072 - RNA, 383 nt, Artificial Sequence
  Synthetic
uuuauaagcuuuaacaaauauauggaauuguuuaucauaguuauuacgcuaucuuuucuaaauuuaauuucaguaggcucuuaaguucuucaacuucguguaucaauuuuaaaaucucuacauuaguuugauccucuucaauauuugucuucacacauugaacucuuuuaucccagccaucaguauuaaaaucguuuucagccauuaacuguucccauucuuggagaguaucaucaucaucuucaccucggcuccgauuagcuguaacuuuguucgcacugcauguuucaaaccaagccgcaacuaggaguagagguaaauaaagaacugucaaaaccauuucauucaaucgagcauauauuugacguggcagccaccauuca

SEQ ID NO: 1073 - RNA, 398 nt, Artificial Sequence
  Synthetic
ucaucaucaagcuccugauccaucauacuuugacuaaauuuuucugccaaacugcuagccugaguuggcauaucuuguccuuuugagcgccucgaauuuauaagagaauuuuuauuacuaaugguacuuaagccaaccuccuuagaacuaguuuguguugcaguguuuuuaagaggguuugaauuuuuuuucucagcuucucgugccauagcugcugaguaauguggauuuauagggccuggaggauauaaaugugcuauggcuauuggaacagaaggauugggucuaucaaaucuuuuuaaaacuugacauuguuuuucauagagcucuuucaacuuugucaacuuaaaguguucugcgauucuauuuagaucaucuugggauccauugagaagagc

SEQ ID NO: 1074 - RNA, 398 nt, Artificial Sequence
  Synthetic
aucauuaagaacguaucuuucaggucgacgagauuugacaccuauugaaauacugaaauuauggaaaggccuauuuuauugcauguggaugucugaucgaccgcucgcacagcaaggucuagccaauucauuagcucaguuaaucuucauacugccacuugagagugucauuccauuucuacguggauuuuggcaaaccaugcaacgcgaguggaccagcauugauguuuuacguauggaaaaauuuuugcuccuaacaagacgguaucuugcugcuaguuuugaaauauuaaaaaaacauaaguggaacgagaacuugauacaagaaauguugcuuuuacuagcugaaauaccuuguaauguagcagaguuaagaguaccuaauggaauacgcuauc

SEQ ID NO: 1075 - RNA, 389 nt, Artificial Sequence
  Synthetic
cuucguaucguauaacaacaaccguuuuuucuccuuuuuuaaucuuuccauccucgagcgcaguaauaaagucaucuucagcaucaaagcauuuugcuuugccgacaaaucguaagccuucuuugccaguaauuuugccaacagagccaccaggugccagagagccucguaauaucugaauaugcccuguuuuuuuaauaggauuagaaaagggucgaaugauugucugaucacuuggaaaaucagguacauucugaacauuuucggcaagcguuuuucccguaacuguuaugcccgagccaucaauaauuccuucuuucagaagaaguuugaucagcgauggaguuccgccuauuuugugaaggucaugcauaacaaauuugccggaa

SEQ ID NO: 1076 - RNA, 394 nt, Artificial Sequence
  Synthetic
uuccacucucuuucaaaaaaguguugacacucaaauguucaucacuuguuccugguggagugucuacuaauaaauauuccauuucgccccauucuacaucuuuuaaaaauugcuuuaucaggccguuuuucuuugguccucuccaaauaacugcaucaucucgguugggaagcauaaauugcacgcucauuacugcuagauuuucaaguacccaaacuggacuccauccuguauuacugacgugaauaaucucuuccucaacucccaucauuuuuggaauacuuggcccgcaaauaucuguauccaugacaccaaccacaauuuccgggucuuuugcaagugcaugugcaagcaguguuguaaauguacuuuuacccacuccacccuugccuga

SEQ ID NO: 1077 - RNA, 398 nt, Artificial Sequence
  Synthetic
uuucuaauaguccgcuaaaacuuuuuucaucgucaucaaccaaacucacugaguuggguaaaaguaacucuuuuuguuguuuucuuguagcagcauauugagacuuaaacuugucacuuugaccuaaagcuucaugaauaugcauacauucaaacaguggaguaaaaucgaccugcaacucuucauuauccaaaacguuaaauucuucagucucaucaaauacaagcucaauggcagaauuuaguuuaaauuuuccgaguagaggauuugucuuuauucuuucuuucuggcggcuucuucucaauucgguaugauaaaaugcuaccuccccaagaaauugugauguuucucuaauucuguauagccauguguucaaaucagacauaacagccucugau

SEQ ID NO: 1078 - RNA, 396 nt, Artificial Sequence
  Synthetic
cauauuuuuagcucucaacauaagcuacgggcaguaacucaagcuccgacuaguuacccgagcuaucaaauguacuuuguucuuucauauuuaugacugaaauuaugcgaggcuccucauuuugaaugcuacgcugugaguagguagacuuccuggaucuuuggucugagacagagugacuauaauaaacccacauuuuacaaggaaugauacuauaaaacgacuaaauaacucugcggaucuugcgucucacuagcacuuuuccucacgcuuuuccgaccccaccuccaucaaguucaccaucacuucucagcucucagaaguuucauacgauaauuucccucaucauggcagaauuugugcgagcucagaucuucgggacuaccuucgagauua

SEQ ID NO: 1079 - RNA, 397 nt, Artificial Sequence
  Synthetic
ucagaaacauaaacaaagcccauaacacuugcaucucguauuguuuccugugagucugcuccugacgcauacauuacggcaagaauacaauucaucaucgauagauuaggcucuauuuuuucguauaauucuuggucaaaaauuucuucgccuccaggcauaaaugauaaugaauuuaucucuuuaauccuguaaauaaaaaccucgucaaaauuaaucuggagcguaugaggacuuaaaguacuauuagguacgccaaagaaguauucuuuaauagagcauucucuacucugccucaaguauucuucaucccugucaacacauccuccugacuuauccaacuuaauuaggguuauugauucuccuguauuuguuuugagggaagagaagcgacgau

SEQ ID NO: 1080 - RNA, 398 nt, Artificial Sequence
  Synthetic
aucucccaucaauaucccaaguccaaguucguggaccuacugacgcaccucucuauaaucauuacgcuggucaaaaaucgccauaugugaaugaucgguugccucauuuaccuuuaccccagccgccacaggcuuacucuccacgucuugguucgauaacauccuccguuguucugaacgguagcucuuuaucaccuuauucaacuagucaaucuucuacggggcccaaaacuccgucuccggugcugcccaacagugcaggauuaccuuuaucucuggcgcaaacaccguauaguaauacuucuccaaucgcaccaaauuauauuugcgcucacgaaccuuucuccgcaaugaaucacaauccccaagaaauguauuacccaucucaucuguccgcg

SEQ ID NO: 1081 - RNA, 375 nt, Artificial Sequence
  Synthetic
aaaaagaaauauccuagaguuagcgcuuuaccagcacaaguauuacccagucuuucgguuacggaagaauugcuggaagucuucaaucaaaaagcacaguauuuaacacccacacuacaugagccaucuuuaaaaagagauauacuugauguuuaugauggaaguucugauccuuaucagaacuuuguuguucgaauaguacucucuauuucacuacagaaauuggacucugcguaugcuggguuagcugauaguuauuaucuagccgccauugaguuuuuagaagaaguuaucaggccgaaagaucucaagacucuccagugucuaguacuuguggcucaguacucauuauuaaccccaacucaaacugcuauu

SEQ ID NO: 1082 - RNA, 398 nt, Artificial Sequence
  Synthetic
gcuuuuuugagauggagucgguggagacauuauuagauccaggugguggaaucagcaccauguuuaauuuauugcugagagagguuugugaaugagauuuggaaggccuccaagcugucuuuuggggagauuucguggcgguaacaguuuguggagggggauuaaacauaauauugauucucgccgaugcgucucuuaagcguccaaguugugcugguugugacauugucugauucauaguuuggaacaugguggcggauuggucugggucuugauauauuuguaaccgcggcugcggguaugguguaaaagacgacaugauuacucuuaacucuggcacagucaaugaugacuuacguucgccguagacaauaaucggguaaaauaacaacgcugau

SEQ ID NO: 1083 - RNA, 241 nt, Artificial Sequence
  Synthetic
ggugacuucggccucucuaagauaaugaaaucacacgauuuugcaucgacauauguaggaaccccauucuauauguccccagaaauuugugcugcagaaagauauacgcuuaagucugauauaugggcccuuggcugcaucauuuaugaacuaugcucuagagaaccaccuuucaaugcuaaaacacauuuucaacuaauucaaaaaaucaaagagggcaaaguuucaccucucccuaaua

SEQ ID NO: 1084 - RNA, 392 nt, Artificial Sequence
  Synthetic
uuauauuaauucaugaaaugaacucggucaaaagcagcccacucacugaucacugauuaacccuuaguucaucacauaaaauuaucgugguuccacauuaacuccuaaauuggacguauaaaaguaaauuacuaaaugaauuccuauucccaugauuaaccaaaaagagccaacacuuuaauaauauccuuuuucguuuccucaguuugcuagaauagucuucacuaaaucuauguaauuaaucucuccacucgagguauugacugcuuucaauaauucaucaaccucuucaucacucauuuuuucgcccaaauuugucaggauauaucgaaguugucccacaccaauaaacccagucauuucuuuaucaaagacuugaaauccacgacaau

SEQ ID NO: 1085 - RNA, 378 nt, Artificial Sequence
  Synthetic
uuugugauccccgaaaaaaaaaccacguuccauaucggaauucaaaguuaacucgacugcuaaaguuuucucucgguggcaauugcaagaccguaaugauuguuugcguaaguccgucuagugcacauuuugaugagacucagaauacauugcguuaugcaaaucgagcaaaaaauauucaaaccaagguuaccagaaacguauucaauguaaauaggcaugucaaggacuuuuuaguaaaaauugacgagcaaauggccaugaucaacgauuuaaaagcucaacaaaaagauuuagaaacgcuagcauuuucuaaauucaaaaagcaaugugagaaacgagaaaguaucaugagagaaggaauuacacguauucgug

SEQ ID NO: 1086 - RNA, 396 nt, Artificial Sequence
  Synthetic
acugagucaucgguuagcgucgcuacaaucuuaccugaagaaaauaaucguuucauugcaaaaacaccuacuaaggauucuucaaauaagcuuagaaaauuuauagaagauucuaggucauaugaccuagaaauaaggacugauaauaaaaaaguugaagauuuaauucagccaucaccuuguagcucaccuuauggaagcaaaguuucacuuauuaauuuaaaauuaagcgaugaugaaacuaacuuugcuucuaagauaacaauuaagagagagauuauuaaagauaagcaaugcaauccuacuugucauauucugcauaauaccaucuuaucucuaguucagccuccuauucacaccuacaaugguuucuuugaccacucuaaugaagcuggg

SEQ ID NO: 1087 - RNA, 398 nt, Artificial Sequence
  Synthetic
uuucuuucuuuauugauaccuugacuuuuucuccuugccucauuacuuuuuccgaauagaggugagcucccgcuuugaaauggauuaucauaagugaacgcacuaucuuguuguuccucuaccuuuucucugggaaguuuaucgggggucucaugguugacuucgacauaaucuaccuggugaugugaugguguuucacucuuuuugcuccucaaugacuuccuucucgugucuugaucuagcccuguuucaguaucacuuacccgggcguguuuacuacuggcccugggcguuuucuuuacuggacuucgggucuuuuccuuucuguaaccuacuuccucaucuucuaauucgucaacuuuuaaccuugcacuuaaauuucuaguauuucuucuuga

SEQ ID NO: 1088 - RNA, 398 nt, Artificial Sequence
  Synthetic
aucuaauucuucgucuuuucguaccucagggcuuugaauggcacggcuacuuugcuuagguguuucuacaucaaauauguuguucccuacauugagcugcaaauuugcuauaggguuuaucguaucuggacugcgacuuaaucgauuguuuuccuggcuuuuuguacuuuggcuaaauauuugauccuucagugaaguaucauuuguguuugcucuagaucuagaagaccaaguauuucgauucgauggugucauaguacgagaauuauuauaaccuuuguuacuuuuacgccggaaagggccaugguuuuggaagaacccaccuuucuuuuuaaagacuggacuuucugaugaaggugaacuuuguuugauugguguaguuuugcugcuaauagcuu

SEQ ID NO: 1089 - RNA, 204 nt, Artificial Sequence
  Synthetic
agucucacggugcacauucacagucucaucaguuuguauugcauuugcgauaccaaaaucaauuaauuuuaguuggccuugaacuaggacaaaauugugcggcuuuaaauccgaaugaacgacaucaugugcguguauugcuuguaggcacucaagcaucucuuuccaauagugacggacaaaacugggaucaaauuuggaauu

SEQ ID NO: 1090 - RNA, 371 nt, Artificial Sequence
  Synthetic
uagccuucgaaagauaguaagguuacccgaaggugaagaugaaaaugaauggcuugcugucaacuugguugauuuuuacaaccauauuaauuuacuguacgggucgauaacagaauucugcucgccgcaauccuguccugagaugaaagcgacugaugaguaugaauaucuuuggcaagacccugaaaauuucaaacgaccgacuaagauggcugccccuacguacauugaacacuuaaugggauggguccagaguaguaucgauaaugaagcuauauuuccaaguaaaacuggaguuccuuucccaaaaucguuuccaaguauuauccgacaaguuuuuaagagaauguaccgaguauaugcucauauuu

SEQ ID NO: 1091 - RNA, 355 nt, Artificial Sequence
  Synthetic
aaaaaaauugucguaaaucuaagaaggcuuguuugacccacuaacgagauuaacaugcuccucgucacuaucauuauuugaccauuuguccccgucuucaccaacaguaaauaucguuucucuuucuaagcucucacguguuguauuuuuuacagucuuucguccggaauuuuucggcgcaggauuguaccucgucucuucuggccuuugaucucuaucuucuuuuuggccuauaguagacucuauuucaucgucuucaacuccaaagucggauauuucaaaaccuucaucguccugugcuaacucaucacucauugcgaaucuucgauuauuuucgguaggucgccacaaauaa

SEQ ID NO: 1092 - RNA, 384 nt, Artificial Sequence
  Synthetic
uaugggaagauuagaugagcucacaggagacaaaagauccucuccuaccuccccauacgguucaagcgaccucacacuauuggccgagugugaucuaugguaaccauaugaaucugauugaagggacucaacugaaucuuuauaugucccguuauuuauaucauucucugauaucucauauacuuguccguauggauaauaugacccaaucggauuuggguuaguccuuacuugauucgcuugagcuauagcguacuuuuuucuaucuucuucacccauaauacucucaacccgucuugguaaguaaacagagguuguuguuccggcagaaaaguuacugucaaaugaaucccuaugauacauugguggucugcuaacucccag

SEQ ID NO: 1093 - RNA, 387 nt, Artificial Sequence
  Synthetic
aaugacauggauuauguugaacaucauuuugguccugcaggcuuaaaucgacaggacauuguccauacauacagaacucuuaaugcaaagauuauuaaagcugaccuccuucguuauuugauuauguauguggaaggaggucuauacgcugacauugaugucgaagcuuuacguccaauugaacguuuuauuccagagcgauggaacgagaaagacauugauaugauuguaggggucgagauugauaugccgcauuauuccgaucacccuauucuugguccuaaaucuaaaucauuuugccaauggacauuuaugugcaagccacgucuaccggugaugaugcaauuaauugauaauauuaucgucuggcucaaucagcuuucccga

SEQ ID NO: 1094 - RNA, 360 nt, Artificial Sequence
  Synthetic
aaaaucaugaguguaucaucuaaugauaaguuugaagugcuaaauuugaagcguuuuguggauacucggaaagagauugugauuguugcauauugauauuagaguuucuuugcgacguacauauaauugccaacucaguuuuuuuauccuuuugguuacgcguccuuuggacguaaaaugucaaaauuucguuauacuucguuccauaaauuuugugcuucuucuuguaauacuucgggacuauccauucguucaaaagccaucuuuaccugccuuucccaaucacuuaaagagacaauuauccauucacaaauccccaccaaauaaagagcaaugcauugcccaauccauagccccgaa

SEQ ID NO: 1095 - RNA, 363 nt, Artificial Sequence
  Synthetic
aaauuaaggcauaaaaaugcaccaaagugucauaauugcccgucacaccaauuccacacugugauaaucccauauuguccaucucuucuuagaggguuaucucauuuauuuuaguuagaucagacucugagacaauuugaucuguucccauacucgaauauucaagcugcaacucaugcucgauucuagugguccuuuugaggguugacaguguguaucuaaauagcaacaaaauuagacuaagaaggguguaggaauugcaauuucuuauuuaauuucgggucaagcgcuguucguaggcagaacugauauugcguagaugauucacuucauuuucucacauguuauuauuagguauuucua

SEQ ID NO: 1096 - RNA, 398 nt, Artificial Sequence
  Synthetic
auuuaaucguaucaacuuucuguccaacuagcccaaauaagccaagcuuaugagucggacgcuuauuuucuggaacccaguagucaacuagagaugcugggacaggagcugcgacuucagaugaugaguuauuaucuccagcuuuuuucuuguuaaucuugagucucucuguauuugcaauuuuaauaagcuuaacuucagaugauucuaaucuuaguaggagaucgucgcgcucagauacaaggucgucaaccucugaacugucuuuuguuauccaaaccuuuuucacgcaugagccaaauaucugacguaauuuagauucaucucuguauuuagcagguaccgaagugaagagaacuguacgugcggauauuuuaugaguauuuaauggcgagagg

SEQ ID NO: 1097 - RNA, 398 nt, Artificial Sequence
  Synthetic
cuuagcuucuucauauuucucagaguagccuucuuuaauagcuuggauuaauuuugauagcucugauuuaucuucggaucgaacuucaguuauugccaauacagcagcaguuuucuuguguacaacaguaccaagucuagcuuuuccuuuaaugauagcauaaggaacucccaucuuucgacaaagagcuggaagaaauauaaccaacucuauaggaucgacaucauuggguauuaagacuagagaagcuuucuuauucucaaccaaaccaacgacaugauugaguccauacuuuacuguguauggcuucuuacugacauccuccuuguugccauuuuuaauagcuguagcuuccuugagaagacgcucuuucuuuucaccuuuacuuucaggacggu

SEQ ID NO: 1098 - RNA, 397 nt, Artificial Sequence
  Synthetic
aaucgaauuauuuuagauccgcuugauuuggaaauaccaaggauucuucaaauaaaacuggcagcugcaaaauucaagaauaaucggggcagaguacaguauuagagcccacgcaaaucccaauuaacuaugcuguccaaaccauacaucugcuuucuaccuacacaucuagaaaaauccaauuauugucaccacuuuugaaaaugccuucacuguacgaaauaagcauaccgguuuucacuaaaaaacucaaaucacucucuaagauaauggagaaaggagcagcucaugaagcugucucuaaugaccagcugguaaauacccgucugauugcggauauggaaaacuucaccuuucagauccaaaaaguuacugaugcagcaagauuugucgcuga

SEQ ID NO: 1099-1113 - skipped (15 entries)

SEQ ID NO: 1114 - RNA, 395 nt, Artificial Sequence
  Synthetic
aauuagaccuccucuuuucucauuggucacgguaaauugauuuccuaauauauacauuuuguaucgucauuuaucaaccucuaacauaaacuguuucggauaacgacagacucaauauuaucucuauuuucaucucaaaacuacaaggaguacaugucagaaaaaauuauuauuggaccaccuuaauaaaaauuacucacuguguguuugaguuuuauuuuugguuuuuucauuaacuugacuugaaaacaaaugucuuccuuccucagcccggauaugguguggaaaauaauucauuuuucgugaaugaacuuacugccaacucaauuacaaucuuuucuacauuuugcaucauaugccauacuacugucuuuaccguguauucucucucguua

SEQ ID NO: 1115 - RNA, 398 nt, Artificial Sequence
  Synthetic
aguaauucugucuucaaucaauuggcucuugggauucuuccauacacuugcaucucuggcuucaacgacuuggcuucauggaaauuaugaauggcaauggcaucuguugaaucccuucccuguagcucaacgccaauauuaucguucauccucauccacagcuguaauuaaugucaauacaacuucuguuucccggaaagacguuggagauuaucauucuuugacuggaaaagaccaacucgaugacuaucugccuugucgccaauguaagggggccagaaaggaucaugaauugguaccaaaauccaguauuuuagaaucugaaaaucuuauucggccuaccucagucauucucaaggucucauaacuucuugcuuuacaaaucgaaguggacuuga

SEQ ID NO: 1116 - RNA, 379 nt, Artificial Sequence
  Synthetic
aucuaucuaacuuaguuuuuugagggccaccaagggaaacauugguauacaaucacuucauuguaaaaaguaugcguuuuuuuaugugaucguuugauaaccauaacuaauaaaacaagucaacuaaucacucaauaaaacaaaucauucuccgaaguucguuagaaggauaagcacauuauauuagauuugucuguaauuaucacgaguacaaagccgucacucaauuauuuacagaaaaaauauccggaccaauucgaaucccaccggcauauuuuugagaaaaaaaaacaguaaccccaagcucuccgugcauagccguaauuaaauauuuagacgagucauaaacugcuuuacauggccagugcaacaauuccag

SEQ ID NO: 1117 - RNA, 396 nt, Artificial Sequence
  Synthetic
uuacuuauuuaaugaagaucacggagguguuaauauuggaaacaugaauuuuuuggagauuaguuugcuuaggccaaggcuuguaagugaucaguugagugaucaauuaacuaaucaaguaucaaacguuacuucuucauucaccaacugggauaaaugcaugauacaaauuuauugcaaauggccagcaauaaucggacuuguuaucgguggcuuaauaguccucucaauuaucauuuguaugacacgcugcuugugcuuuggauacucauuuuguuguucuugcuucucuuuccuaagcuguuguggaugcuguagaagcugcuguucugggaagagaagaaagucuauugccuacaaaaaucauucuucaucagacuauagaaaucagggaua

SEQ ID NO: 1118 - RNA, 250 nt, Artificial Sequence
  Synthetic
gacugucagucacaccugcaugguauugauuaagaaugggguaauacaauuugaaucuguucauaaaaugaugaaccaacuuacaauccuauuugaugauccgaauaggguucggguacacaacagcuagacuccacgccaacagcaaaaaaacaaacuauuuucgucuuggaucguagaaauucgacgugaugcagucauugccggauacgaaagcucucgggaacuucgaaauauugucuuuuucaac

SEQ ID NO: 1119 - RNA, 400 nt, Artificial Sequence
  Synthetic
uccagagcuauaccugccgggccacggcccgcggggcguuauggucauucucucaauauacuagggucuaaaaucuacguauucggggggcaaguagaggguuauuuuaugaaugaccuuguggcuuuugauuugaaucuuuugcaagucccuacgaacaggugggaaauucucauuaaaaauagugaggaugguggacccccaguaggacaaauaccaucagcuagaacaaaucacucaguugugacauauaaugaaaagcuuuacuuguuuggcggaacaaauggucuucaaugguauaacgauguuugguguuaugauccgauaccgaacuccuggacucuuuuggacugcauaggauauauaccgguuccaagagaaggucaugcugcagcaauug

SEQ ID NO: 1120 - RNA, 350 nt, Artificial Sequence
  Synthetic
cccgcggggcguuauggucauucucucaauauacuagggucuaaaaucuacguauucggggggcaaguagaggguuauuuuaugaaugaccuuguggcuuuugauuugaaucuuuugcaagucccuacgaacaggugggaaauucucauuaaaaauagugaggaugguggacccccaguaggacaaauaccaucagcuagaacaaaucacucaguugugacauauaaugaaaagcuuuacuuguuuggcggaacaaauggucuucaaugguauaacgauguuugguguuaugauccgauaccgaacuccuggacucuuuuggacugcauaggauauauaccgguuccaag

SEQ ID NO: 1121 - RNA, 300 nt, Artificial Sequence
  Synthetic
ucaauauacuagggucuaaaaucuacguauucggggggcaaguagaggguuauuuuaugaaugaccuuguggcuuuugauuugaaucuuuugcaagucccuacgaacaggugggaaauucucauuaaaaauagugaggaugguggacccccaguaggacaaauaccaucagcuagaacaaaucacucaguugugacauauaaugaaaagcuuuacuuguuuggcggaacaaauggucuucaaugguauaacgauguuugguguuaugauccgauaccgaacuccuggacucuuuuggacu

SEQ ID NO: 1122 - skipped

SEQ ID NO: 1123 - RNA, 350 nt, Artificial Sequence
  Synthetic
augucugaagacaaugcuacucguaaaaaaacaguuaaacuugaggaugccucuggcgcugaacaaaagacgauugaugcuacugcgacugcuauuuuaaaaaagaagaaaaagccaaauuccuuaauuguaacagaugccaucaacgaugauaacucuguuauugcacugucaaauaauaccauggaaacuuugcagcuuuuucguggagauacuguccuaguuaaggggaagaagcgaaaggauacuguuuuaauuguacucgcagaugaugauuuagaugacgggagugcucguaugaaucguguuguccgacacaaccuuaggguuaaacauggugauauuguuac

SEQ ID NO: 1124 - RNA, 300 nt, Artificial Sequence
  Synthetic
aaaaaacaguuaaacuugaggaugccucuggcgcugaacaaaagacgauugaugcuacugcgacugcuauuuuaaaaaagaagaaaaagccaaauuccuuaauuguaacagaugccaucaacgaugauaacucuguuauugcacugucaaauaauaccauggaaacuuugcagcuuuuucguggagauacuguccuaguuaaggggaagaagcgaaaggauacuguuuuaauuguacucgcagaugaugauuuagaugacgggagugcucguaugaaucguguuguccgacacaaccuua

SEQ ID NO: 1125-1126 - skipped (2 entries)

SEQ ID NO: 1127 - RNA, 350 nt, Artificial Sequence
  Synthetic
gucuuuauacaguaggcaacucuacguucuuggacacgaggcuaugaaacgaaugagugcaucgaauauucuuauuauuggcuugaaaggucuugguaucgaaauagcuaagaauauagcucuggcuggaguuaaaagucuaacauuauacgaucccgcucccgcaacuaucgcugaccuaucaucucaauucuuucuuaacccagaagauauaggaaaaccuagagauauugucucagcucaacgaguuucggaacuaaaugcuuacaccccuguuaagauucacagcuccacaagcuuaguuucugaucucucccaguuugauucauaucaagcuguaauauugacag

SEQ ID NO: 1128 - RNA, 300 nt, Artificial Sequence
  Synthetic
guucuuggacacgaggcuaugaaacgaaugagugcaucgaauauucuuauuauuggcuugaaaggucuugguaucgaaauagcuaagaauauagcucuggcuggaguuaaaagucuaacauuauacgaucccgcucccgcaacuaucgcugaccuaucaucucaauucuuucuuaacccagaagauauaggaaaaccuagagauauugucucagcucaacgaguuucggaacuaaaugcuuacaccccuguuaagauucacagcuccacaagcuuaguuucugaucucucccaguuugau

SEQ ID NO: 1129 - skipped

SEQ ID NO: 1130 - RNA, 400 nt, Artificial Sequence
  Synthetic
aagaaaauaauaauguuaucgaugagucuuuauacaguaggcaacucuacguucuuggacacgaggcuaugaaacgaaugagugcaucgaauauucuuauuauuggcuugaaaggucuugguaucgaaauagcuaagaauauagcucuggcuggaguuaaaagucuaacauuauacgaucccgcucccgcaacuaucgcugaccuaucaucucaauucuuucuuaacccagaagauauaggaaaaccuagagauauugucucagcucaacgaguuucggaacuaaaugcuuacaccccuguuaagauucacagcuccacaagcuuaguuucugaucucucccaguuugauucauaucaagcuguaauauugacagauauuccacugaaagaccagcucau

SEQ ID NO: 1131 - RNA, 350 nt, Artificial Sequence
  Synthetic
ugcguccuauuccaaaauucaugguuaaaaagcuucaggcccgcaacgaaccucggaaaggccguggguuuggcuuugugaacuuagcaucuaaugaacuucaaaauagggcuguugccgaaaugaauggaaaagaaguucaaggucgugagauugcaguaaagaucgcaauagauaguccggacaagaccucugaagaauuaacuacacauguaucugauggugcuggcgaaguaucuaauguuggcaacucaaccgaagguacuaauggcgccaucgcuaaagggauuacuaaugauaaacuucaaucagaaggacuagcugggacagcugaaacuguugcggcuaca

SEQ ID NO: 1132 - RNA, 300 nt, Artificial Sequence
  Synthetic
uaaaaagcuucaggcccgcaacgaaccucggaaaggccguggguuuggcuuugugaacuuagcaucuaaugaacuucaaaauagggcuguugccgaaaugaauggaaaagaaguucaaggucgugagauugcaguaaagaucgcaauagauaguccggacaagaccucugaagaauuaacuacacauguaucugauggugcuggcgaaguaucuaauguuggcaacucaaccgaagguacuaauggcgccaucgcuaaagggauuacuaaugauaaacuucaaucagaaggacuagcugg

SEQ ID NO: 1133 - RNA, 250 nt, Artificial Sequence
  Synthetic
ccucggaaaggccguggguuuggcuuugugaacuuagcaucuaaugaacuucaaaauagggcuguugccgaaaugaauggaaaagaaguucaaggucgugagauugcaguaaagaucgcaauagauaguccggacaagaccucugaagaauuaacuacacauguaucugauggugcuggcgaaguaucuaauguuggcaacucaaccgaagguacuaauggcgccaucgcuaaagggauuacuaaugaua

SEQ ID NO: 1134 - RNA, 400 nt, Artificial Sequence
  Synthetic
gaaccaguaucugccaaaauugcucugcguccuauuccaaaauucaugguuaaaaagcuucaggcccgcaacgaaccucggaaaggccguggguuuggcuuugugaacuuagcaucuaaugaacuucaaaauagggcuguugccgaaaugaauggaaaagaaguucaaggucgugagauugcaguaaagaucgcaauagauaguccggacaagaccucugaagaauuaacuacacauguaucugauggugcuggcgaaguaucuaauguuggcaacucaaccgaagguacuaauggcgccaucgcuaaagggauuacuaaugauaaacuucaaucagaaggacuagcugggacagcugaaacuguugcggcuacagcuuaaguuaaaccgcaacuuuuaa

SEQ ID NO: 1135 - RNA, 250 nt, Artificial Sequence
  Synthetic
gacauauaugacuacaucgccaauuuauccuugauauugagcacuuacugaagcuacauaguuacaaguggggcaugcgcaacaauugcaagugaugcuuuaaugaacccauuugauguaauaaagcaaagaaugcaaaugcauaacucucgcaaaauuuauagaucacugagugauugugcccgcuauaucuaucgcacugaaggcaucacagccuucuauaucucguauccaacuacucuuuccauga

SEQ ID NO: 1136 - RNA, 400 nt, Artificial Sequence
  Synthetic
caugggagguaaucaaacaggagcucaucauccuauugcagcaggucuguauuaagaauuuugauuaaggaaucagacauauaugacuacaucgccaauuuauccuugauauugagcacuuacugaagcuacauaguuacaaguggggcaugcgcaacaauugcaagugaugcuuuaaugaacccauuugauguaauaaagcaaagaaugcaaaugcauaacucucgcaaaauuuauagaucacugagugauugugcccgcuauaucuaucgcacugaaggcaucacagccuucuauaucucguauccaacuacucuuuccaugacuguaccauuuacagcacuucaacuucucgcauacgaaucuguaucuacauuucugaacccaucaaaggcuuacg

SEQ ID NO: 1137 - RNA, 350 nt, Artificial Sequence
  Synthetic
caucauccuauugcagcaggucuguauuaagaauuuugauuaaggaaucagacauauaugacuacaucgccaauuuauccuugauauugagcacuuacugaagcuacauaguuacaaguggggcaugcgcaacaauugcaagugaugcuuuaaugaacccauuugauguaauaaagcaaagaaugcaaaugcauaacucucgcaaaauuuauagaucacugagugauugugcccgcuauaucuaucgcacugaaggcaucacagccuucuauaucucguauccaacuacucuuuccaugacuguaccauuuacagcacuucaacuucucgcauacgaaucuguaucuaca

SEQ ID NO: 1138 - RNA, 300 nt, Artificial Sequence
  Synthetic
auuaagaauuuugauuaaggaaucagacauauaugacuacaucgccaauuuauccuugauauugagcacuuacugaagcuacauaguuacaaguggggcaugcgcaacaauugcaagugaugcuuuaaugaacccauuugauguaauaaagcaaagaaugcaaaugcauaacucucgcaaaauuuauagaucacugagugauugugcccgcuauaucuaucgcacugaaggcaucacagccuucuauaucucguauccaacuacucuuuccaugacuguaccauuuacagcacuucaacu

SEQ ID NO: 1139 - RNA, 400 nt, Artificial Sequence
  Synthetic
uaaaggcacuggcuuuguuugcuucuauagacaagaagaugcggacucuuguuaccauggugcaccucguaccuucaaaaguggugcaaacgcuguuaaagcuaaaaacucuauuuuagaggaugaaacugcugauaagaauggcuuauacacaauagaaggucgcguacuucaagugucaagagcaguuaaucgagaaaaagcuguaaaacuuacagaagcugggacaaacuuccgcacugaccgagacaaagauaagcgaaaguuauaucuacuuaaagaggggacaauugcuguugguacgccuauauauaacguuuuaucuccaucagagauuaaacuuagagaagcuucggcgcuacaacguaagaaacuuauagagaaaaauccugcacuucau

SEQ ID NO: 1140 - RNA, 350 nt, Artificial Sequence
  Synthetic
uauagacaagaagaugcggacucuuguuaccauggugcaccucguaccuucaaaaguggugcaaacgcuguuaaagcuaaaaacucuauuuuagaggaugaaacugcugauaagaauggcuuauacacaauagaaggucgcguacuucaagugucaagagcaguuaaucgagaaaaagcuguaaaacuuacagaagcugggacaaacuuccgcacugaccgagacaaagauaagcgaaaguuauaucuacuuaaagaggggacaauugcuguugguacgccuauauauaacguuuuaucuccaucagagauuaaacuuagagaagcuucggcgcuacaacguaagaaacu

SEQ ID NO: 1141 - RNA, 399 nt, Artificial Sequence
  Synthetic
gaccuagcuugacaccuuuauagugguagggcucuucagaguaaccuccaguagguguaggguaacuggucccuguuggcgaugcguaaccaccuguaccuguugcagacggguagccaccggugcccgauggagaugaauagccgccaguuccaguugcagacggauaaccgcucguagcaguuggcgauagaaagccaccuguaccagaugaagguggauacacacuuccaucaccauucgaugguuggccauaguagccaccaccuuccugucggcuucguagaugccaaggugaguuuggugcuggagcaguugaaacuaguccaaagcagaggagaccaaacaggacgagagguacguuacaaagcugcaugauggauauuuggaaaggcaaac

SEQ ID NO: 1142 - RNA, 349 nt, Artificial Sequence
  Synthetic
guagggcucuucagaguaaccuccaguagguguaggguaacuggucccuguuggcgaugcguaaccaccuguaccuguugcagacggguagccaccggugcccgauggagaugaauagccgccaguuccaguugcagacggauaaccgcucguagcaguuggcgauagaaagccaccuguaccagaugaagguggauacacacuuccaucaccauucgaugguuggccauaguagccaccaccuuccugucggcuucguagaugccaaggugaguuuggugcuggagcaguugaaacuaguccaaagcagaggagaccaaacaggacgagagguacguuacaaagcugc

SEQ ID NO: 1143 - RNA, 299 nt, Artificial Sequence
  Synthetic
guagguguaggguaacuggucccuguuggcgaugcguaaccaccuguaccuguugcagacggguagccaccggugcccgauggagaugaauagccgccaguuccaguugcagacggauaaccgcucguagcaguuggcgauagaaagccaccuguaccagaugaagguggauacacacuuccaucaccauucgaugguuggccauaguagccaccaccuuccugucggcuucguagaugccaaggugaguuuggugcuggagcaguugaaacuaguccaaagcagaggagaccaaacag

SEQ ID NO: 1144 - RNA, 249 nt, Artificial Sequence
  Synthetic
uuggcgaugcguaaccaccuguaccuguugcagacggguagccaccggugcccgauggagaugaauagccgccaguuccaguugcagacggauaaccgcucguagcaguuggcgauagaaagccaccuguaccagaugaagguggauacacacuuccaucaccauucgaugguuggccauaguagccaccaccuuccugucggcuucguagaugccaaggugaguuuggugcuggagcaguugaaacua

SEQ ID NO: 1145 - RNA, 397 nt, Artificial Sequence
  Synthetic
ugugcuuggaaagcagugacaugugaucucauauuaccaacaucaaugucauuucuuccuugggugggaaacauaauacaaguccaugguccgauuuuggcggguguaugaaaucucacguuaaucauauuccaacuaccauuucucggugauagacuuccagauccuccauaucucacagacggugguuguaguacucgagcauuuacugauaucaaagacugaccuacuugaaggccaaauucagauagaacaggguugcuagaguucaggcucaaaacaugucuuccaucuugaacaacugagguagcauuuugggcagguguucgacaugcaaacuuuaucauuucuuguguuugauuuggucccaacuuuuucuuuacugguuguccaggaa

SEQ ID NO: 1146 - RNA, 397 nt, Artificial Sequence
  Synthetic
uucacuguuuccaacauuaacuacaggauuuauuggauccaauucaaucuuuggguaucuuuuuuugaaguaaucauauacacugauguaaguguuagauggcaagggguuuuuuuggcugguuuuagaagugccaguaucuucagauacccaaaacuugaccuuuugaggaccagcaccauauccagcaaccucuggucgaugcuccucuuuggcaccaucauuaauauuugcaaggccuugaaugguuuuaauccuugguauaaccuuuccgguuguuuuauuaaucuuugggggcagaugugugauuuggauucgcauuccuuuuaacuuuucuuucaaauugacacgauuuugcguucccaucuucuuauauagggcggcgagguuaguaguu

SEQ ID NO: 1147 - RNA, 351 nt, Artificial Sequence
  Synthetic
uauugauauuauaaguuuucuuaaaauaaucauauacagauauuuucucuuccguaggagggucgguuuuucuauuuuuaaggcuaaaguauguguuuuuagagugagcaccaccuugcucaccagagaaaguaaauccuuuuauauaauagacuuuaugaucaucauuuuucccucgauguuugacgguaaacuguaaucuagccauuuucuguagguucuuccaauccucugauuuuuuccaccuaccauccuucggaucucgaacuggcuguauuaaaucgcgaaaaauauuccacugcaacugacgguuucguucuuuacauagauuacgagcugccugaugcagau

SEQ ID NO: 1148 - RNA, 349 nt, Artificial Sequence
  Synthetic
auuacauaguuaucuagggguuacaauagaguaauaaucauauauucgcauuuucuucuaugacugacgaugaaguuuuacucgaacuagacgcugguguuuucaaguuuuuacuagcugaacccgucgaggaauuuaaaggcgaguuuuucaauccagaaucagguucaguaugauucuuugaaccacuuaggucagugccugaauuaguaucaggcacaggcauugaguuuaggguuggauuuaauaccauaggugauauucuaguacucugugugagaaucguuucaucaauacuuugaagaggaaguaaugaccacccuucagguauaguuacucccugggggag

SEQ ID NO: 1149 - RNA, 342 nt, Artificial Sequence
  Synthetic
ugaucacaucguugguauggauguuauucuugcugauggacaggaaauuuucgccagugaugauacaaaucccgauauuuucuuugcuaugcguggugcuagugauaguuuuggcauugcaacauaucuguacuuaaguaccgaaacugcaccagauucuaucauacacuucaacguugaucuugcaccaucacucgaagauucaaaaauagcaaguacaggauuagaacaaauucaaaauacuguguuaaacucaacucuuauaacagcucaaaucacguuuaacuucuuucucaacagugaugguuuauuuucgcuuaauggauggugcauggauuguaa

SEQ ID NO: 1150 - RNA, 398 nt, Artificial Sequence
  Synthetic
ucauauugcuagugaauucaucaccauuaaauuuucuuggacugaauuuauccucguagcuaagaaauuuuucauugguuucauuuagaucgaaucuauaauuaaacggaguuugguaauaaucauaaucagugggguuuguacuuguaaaagagaaauucgaugcgauuuucgagaucuguuucguaauaauuuuuagcgccucguguaaucgaaaucgugaauaaccuggcuguucaaugguagggaaaaauugucggaaugugucauaaccaacgaccaaauuaccuccacuauucgaggagagaucaauaaucauuuuuguuuuccccaaagauaaacacucagcaauuaaagucuguauuacugacuguguuuggagcacagauuuagccugg

SEQ ID NO: 1151 - RNA, 396 nt, Artificial Sequence
  Synthetic
ccaguccuugccaauugucucaacaucuuuaccacauacugcuggaugauauucgagcucagcuccacguuugcauucaucacuacagaaugagauuucaucacacucgagacagcucauugcuguacuuucaguuucauauagagaaggaauuucagcacuacaagcaucacauagagggccuuugagucuauuauuaacagugagauaugacagcucuuuaaggauugauucgcccgguaagauguuuucuuuugcaaauauuccaaguuguuuacuugucgaugguaaguugcuuugaauuugcuuaacuuguuuaccagcuaaagauacugguguugaugaguucuucaagcucagcaaguuaguaauccuuaccucacauuuuggcgcaau

SEQ ID NO: 1152 - RNA, 306 nt, Artificial Sequence
  Synthetic
uuauacuuagugggaauuuuauuuugacuucucugaagcaugauaucucuagccacauuugcaguauucucaaguuccucauugcuaaaaaaaaauuuaccacauugauauccagauauuugagaugguaccgguugauuaggugcaucugaaauuaauucuguagagauuuuucuuguuuguugacaucuuaugaaguuauucaucagcccuucaacgacuacaucaaugaacucuccuuccuuguugaggauuaaaaaguaagguuccacuuuaccagagccuugcuuauaaaauuuacguuga

SEQ ID NO: 1153 - RNA, 327 nt, Artificial Sequence
  Synthetic
aaaagaucagaaaaauaaggcaucgaauucagaaaaaucacaugacucuagcucaucuuccaaaaagcaagccaaugcugcggaaaaugaaagucagaguauucaagaggugaccauaggagguaaagcaggaguucuuguuggcggugguaaugguucaaauucucucgcuaguggccuaggagcucuaacaacgaaaggcaaaucuggggaagaaaaaaaagcaaaaaaggccgacgaagucaaugcagaagcggagggugaagauggggaugaagaagaaaauccuucaaagacuaaaggcucuggaaaggaagacaccgcgaa

SEQ ID NO: 1154 - RNA, 393 nt, Artificial Sequence
  Synthetic
auucaaauguacaaauuacccacccuguagccaaaauuuccgaaaacaucaaacucuccagcgucauauucgcucugaacaucuucagcuuaugccguaucccuguguccauguugacccugucacuggcgaaaguugcaacucagguuucgauaguuccgccagccuucgucgacaccaagagcgagcucauggcagugcucgauauuucuguaaugaauguugcuugacaggaucuuuuaauucagaugguacgccauuaaaucuaggcuucacaaguuauucaaaguuacaggcucauauucgaaaagaacaugcagaguguauguuuuguaauauaaaauuucggagugaacgugaacuacuaucccauguugauagcauucauucggg

SEQ ID NO: 1155 - RNA, 398 nt, Artificial Sequence
  Synthetic
uguuuucuugacuuugccuagaguuucgcucuucucuucuucgucuccuagugugauugugcucgucagcaauucuagcuuccgggguuguaugccuaguucuugaggagcuaggccuucuagaauccucauggucucgucgguucugcccucuucgaauauuugggguuucuguaagugcuucucguaaacuuaucucacgaauuucaucgacaaggcuucuaucggagucuucuacucgucuuugucgugaugaaaacucccuuucuccgguaacaaccuuagguaauacacagucgccacggcaguauauuuucuuuaauuccuccaguucuucggcucuucgacacuuaucaggauuugcagucaagaacauuucgaguagcguugucacugua

SEQ ID NO: 1156 - RNA, 398 nt, Artificial Sequence
  Synthetic
ucaaucgacaagagaauauucauagauccaaugaaaacgccauguugugagaaaacguacugcaaugacugcauuacuaacucgcucaucgagagcgacuuuaccuguccagguugucagacugaagguguauuguuggaugaucuuauacaugaugaagcuaugucccuugagauacagcaguaucuugaagaaaaaaauaaccucgugcgagaggagagggagaaaucuaacagucccauugugaauucccaaacuacaaugacuaugaaaaaagacaaguccaagucaccaucgccaucuguacuaaaaccgauagcagucaaugugaauuccccaucuaacucaucuacugaaucaaagauaagugucacaaaugauaguacuaacaacccaaa

SEQ ID NO: 1157 - RNA, 348 nt, Artificial Sequence
  Synthetic
uugguuucauaccauuaaggcucuuagaguuuggcagugugucucuauauccaauuaugcguauguauucaaaaagcccuagggaucgcugggagcuuacacagccuccugucuucaaauacggguuuuaucuacccucugcaauccuuguauacauuuuguguauuguauacucaauucuaccggcugguuauaugguucuauuuuuugggauuauauacuucauuaacaguuauuacacuuacaaguaccaguugcucuaugccaugaaucauccucaacaugcaacugagggugcuuggccaaugauaugcuaucguauucuucugggguuguguguuuuucaaa

SEQ ID NO: 1158 - RNA, 398 nt, Artificial Sequence
  Synthetic
uacacaauucuauucuugcuugcgaugaaguauuaagcucaguugaaucgaauuuaguaaccuuucgggaugacuuggcgcaagucucuguugauauagaaacgauacaggcccggucaaaugcucuaagcauaaguuuagauaaucgaaagaauacugaacagauacucgguccuauuguugaagaaaucagcauuccaauagcaacuguuaggaaaauuguugauggaucaauggacgaggcauggguaaaagcauuggcugauguugaaaaaagguccaaaucauuugacucaaaaaucaaagaucgacgaaauauuaaaggcauaaucagcuuaaaaccucuucuugaaacucucauuuguaaagcuauugaaagaauuagagauuuccuuguu

SEQ ID NO: 1159 - RNA, 396 nt, Artificial Sequence
  Synthetic
auucccuugugaaauuauuuuuggcuaauuucccuuuccuagaauuugaauuacgguagcuuuuuuuuaaagguauuggaaauugguuguuagaugaauugucugaaacucuaccauuugauaaugucggagacucaagagauucaaucguuguagagacuuuagaagagucugugcuauugcacauuguauuuuuaguaccaauugacaauuccuucuguguuucuugaucuucaguucuucuccgcucuguacgaccauuucuuuuagcuacagcaucagaucuggacuuuucuuuaucaucuuucaaaucuuuuucccuuagggucuucgagcauguacuucgcgguuucuuacuauuuaucauacguucauuacccccaucaucugauucag

SEQ ID NO: 1160 - RNA, 381 nt, Artificial Sequence
  Synthetic
auuuuuuucggaguuuuucaagucguugggcagcuuugaauuuuuuccgacucuuagccucacguacuuuuuugauuggucgagcauucagggcucgcagcuuuucuuuuauagcauuugcagcggcagcacugauaggucuaugagguuuaucauguuuacucucaucauccagaaaccaaucaggaaggccaucgcgauccuugaaugaauuuuuauuccaaccuucaucgaugagaucauauuuagucuucucaccacuugcaauuugaugagcaagugucauugcuuccgcgguuauuauaucaauaucaagucuuccauucuuggaagguucuucuucccauucuguuuccucaacauguuuuuuaaccacuucaa

SEQ ID NO: 1161 - RNA, 392 nt, Artificial Sequence
  Synthetic
aaaauuuauuucgaaguuuucauaauaaauuuugugauguuugcuuuggaaaugagagaaauucgaacaagggcccaagccaacuuauuuacugucaaggaugcucaacuucaauccacaaaaauugucuugguccucgaaguaacagagaucacuugguuacuaaaauuggucaugagaauuuugucuuacaaugucgucguugcauuggaauugcgauaacgaaagacaaaacugcgccucgucuagaugugugcauaguaugucgcgaauugggccuuucauguugggcauucucuaccaaaaugagugcucgacaagaagaaaaacuccggaaacaaaaugaaggaauagauccuauaacggagauuuccagugaacuuaucaacaau

SEQ ID NO: 1162 - RNA, 393 nt, Artificial Sequence
  Synthetic
gcucaguuuggcauuuuucuuuuuauuaguaucuucauccauaucaauggcaauuccuuuuucaaucgguaaaauauuagaccuugcaaccaaaaacucagaaggaaacacacuuuuugaacuuaauaaucaacaauuuuucggggcucuugggcuuauacuaucaauaggugcuguagcuaauuauggacggauauuaauucugagaauaguuggagaaagaguaauuucaagacuccgaucaaaauuauuucgaaggacauuuguacaagaugccgaguucuuugacgccaaucgagucggggauuuacucucgcgacugagcucagauacuguaauaguugguaaaagcauaacucaaaaucuuucagaugggcuucgaucacucguuag

SEQ ID NO: 1163 - RNA, 391 nt, Artificial Sequence
  Synthetic
uuacuacauuugaacaauauguacagacacuugaugcagaaguucagcaguggaggucuggagauagugugccuaaagaaaaauggguaccaccuuuagauacugcuaaucuuucuaaaauaaaaacaccaagaccugcaacuccuucuaggcugcagguagaaucuagaucggaagcuucaacguuauuagaucgcucaucuacgccaauugcauuagaaaaagaugaucgugaagaguuuuuaaaaagagaaaaugagcuucaagaucaaauugcugaaaaagagacucuaauugcgacugcagaaaaaaagcuaaaagacauaaaagaggaauuaaguuaucucaaagaacgggauaucaaaucuauuagggagaaugaaaaauugau

SEQ ID NO: 1164 - RNA, 398 nt, Artificial Sequence
  Synthetic
cucauuccgugauuuauccuccacauggucucaagugaacaugccuccuaucccaucuuugcccgaccuuauuguucaagacaugccgaaaaguaaaaguguauugaaaaaaaaugaagcacugcggacccggaaaacuucagcacaaaaauuaaccauagauucuaaugcgcguguggaaucuucuggcggaccuaacauuucaaauuaucaauacccaauuccaaguccaagccuuuccauuucuagaaagucuauuaauuuuucauuaccuacgcauucucgaccaaacucaccuaucccacagagacuacuuaauucgcaauugauaaugaaucccgcuaguuuauuuccucucaguaacccaaaguugguaaacgauacaaauucgauaggaa

SEQ ID NO: 1165 - RNA, 394 nt, Artificial Sequence
  Synthetic
aaaaacuaaugguaauuucaucaaagaugaccucaaagacaccugaaauacaaaguaauauuaccucuucaaauauaucacuuaguacaucagaaauuggaucuagauuagauuuaccugaagcauuaucagcagaugcaccuacuacuauuuguggagauuuaguuucauuuuuacagccauugaaugauucuacacuuaaaaagagagucuauacaaguaagggacgguccacuacucguaaaccuaaaucuaguuccacaaauucuuuaguuucgucuguuucaaacaagcgaaaagugagucgaaaaucgguugaagcuacugcuguaguaacugcaccaucaacacguucaucuagacgucaaucucuugcacauaccacugaagaaga

SEQ ID NO: 1166 - RNA, 398 nt, Artificial Sequence
  Synthetic
uucuguuauuaccaugcaagacuuaugucaugaucuucguauugguaaaaagucuagaaaccacgaugagauaaugggacgacuugcacgaaugaaacaaaaugcuaucaaagcuaggaugaagcgagauaacccugaacuugaagauuauauagauggaaaaaguggugacaauuauacccuaaaugaaaguagaaagacugagccaaguuuaaauagccaaaucgcaccgccgucugcuccuccgguugguccuaaaauucgcaucguugauggucagauugucuucgaugagcaaucucuacaaauugaccgccauaagagugcacgagaaaauuuuuuugcugcagaagauguuguugaagaaaaugauuuuacucguguuguuuccugcggug

SEQ ID NO: 1167 - RNA, 391 nt, Artificial Sequence
  Synthetic
ucuugcagaugguauugaugaugagcaauauauuuaccucuuuaaggccguuguaggaaaaugugucgagaaguuucgaccuaccgcccucguucuacaauguggugcugacucccuugcuggugaucgacuugggcgcuucaacguccaaguucaaggccauggagcuugcguugcauuuugcaaaucuuuaaaccugccucuauuauuacucggagguggaggcuauacaccaagaaauguagcuagagccugggcgcacgaaaccaguauugccauuggaugugauaauaaacuaaauccaauuauaccgcuucauacacccuaucgauggcauuuucgccaugaaacucucuucccuacuuuagaucaagucuuaucagaaccucga

SEQ ID NO: 1168 - RNA, 398 nt, Artificial Sequence
  Synthetic
uaugucgacaaaaaucuccguaccuuccuuauguucauggagauagaucgauugcugcuauucuucuugaugcgaugcuugauggaaucaaucacaaucuaagacgacgacuggauguugauuuauauauucuuugcauugguaucauuuauaguauauuaucauaccuaucucggucacggacacgauugaaauaucacuggucugaacuauauagaucacugcuuucucuuguucgguuucucaccacauacacaucagacuugaggggcuuaaaaaauauugauauuuugauugacaaucuaguuaauuuaauugccuuaucuuuauguuguggugaggcauuucuacacaguccuguaucucacuaugauuuauucuacaaagucguugagaug

SEQ ID NO: 1169 - RNA, 392 nt, Artificial Sequence
  Synthetic
uuuccaucguauguaguaguucggguaucaaaauuaacagcaucguuaucaucacgguauagguguacgacuccccauccaacuugaguacauuuuccuauuucugcagacugaaaucgagcuuucguaacuuuuccuguugggcggccuucagguguaaggucggaggugaaauuauuggcauagcuugcaguguugcuugacuguugcugcaagauuuccauaucacuuugagggcaaucuauuugguucucucucucaaugucaaacccuacaauuucaguuuucccaaaucuccaauccuuuucugcguuuuuuaagucuuccaauauauuuaaagcuccucuccauauagucuuuguaucagcuuuugaagcauuacuuuugccgau

SEQ ID NO: 1170 - RNA, 395 nt, Artificial Sequence
  Synthetic
auaacauuaucucuaacauugagguaucggagugauuugcauucggaaaaccuugagggaaacacagauauuugauuaugugacagcgcaagucuuucaagcucauucuuuauuauaucaauuacuucaucaggaaaucguuggauuuguuuguugcuaaaaucgaucguaaccccuggcuuaaguucauuacuaacacuuuuggccucagcugccuuugauuuguucucuuccaaagcauuuuucauugcuucccgggcaagagcaauaaauugaugcggugacauugaugguugugaggaaagcgaggaauuugacacaguagaucguagcauuuucggaguccuucguguuguaauuaaaggugcuguucuaggcguuccauuuucaaucuu

SEQ ID NO: 1171-1185 - skipped (15 entries)

SEQ ID NO: 1186 - RNA, 200 nt, Artificial Sequence
  Synthetic
uccuagcaacaguucuuugggcaugaucacgagcacgauuccaagguagaggugcccaguaaaauguaaaguugaucgguguaaaucccauaucaagaucaugauaaagagcggcaaaagaugagucaaaauucucacggaccucuucuccuuguaaggcaugugaagcaguauauauagugauuuccgccauaacuuuu

SEQ ID NO: 1187 - RNA, 200 nt, Artificial Sequence
  Synthetic
accggagucccgucuuuauaaguggaacgcaucaacucccacauuauaucaugcuuauucucaccgcuucuuuucucuucucuacgagcuuggauuauauucauauaaguccuagcaacaguucuuugggcaugaucacgagcacgauuccaagguagaggugcccaguaaaauguaaaguugaucgguguaaaucccau

SEQ ID NO: 1188 - skipped

SEQ ID NO: 1189 - RNA, 311 nt, Artificial Sequence
  Synthetic
cuacauucaggagcauaucuuucacaucuuugccaucgagagccuuggcaaauaaaguaguccaaauuggcucaacaucaucaauaccagcagccuugauuaaugauuguagcuuaucugcugugacgucaaccccgucaucugcgaggauaagggcagcauacgaaacugcuaauucggaauuugacauuguaguacuuuauuuaggggaaagagguauuguguaaaaauaagauuguaauugaggauacaauucuggaauaaucucugaaggacugagugucuucgaauagaaaaauacgcgaauggca

SEQ ID NO: 1190 - RNA, 397 nt, Artificial Sequence
  Synthetic
uuuuuccugcaacacuuccuggcucuaaacgucauagucauaucgaccaggcggucauuuugagaaauuuuacaauccauuuguuaauuacaauucguuucuuaguuuuauaucuucagcaaacucuugauacuaauauuugcaagaagaauuugacaagaaccuucgggcgcuuaacuaauaccacuauuuaugagauaauugcaagauggccacugaaaucccuauuccugucucugcugaugguggcguuaauaauggaaucaauaaaggcaccucaaagccugugggacaaaagaauuuuggggucaaaaccggccuggcucgcauguugaaggguggcguaauuauggauguggucaacgcaaaacaggcaagaauagcugaggaagcgggc

SEQ ID NO: 1191 - skipped

SEQ ID NO: 1192 - RNA, 398 nt, Artificial Sequence
  Synthetic
uaacuauugcugaguauuuccgugaugaagaaggacaagauguauuacuuuucauugauaauauuuuucguuucacucaggccggcuccgaagucucugcucuucucggacguauucccucugcaguugguuaucaaccuacacuugcaguagauaugggucuuaugcaagagcgaauuacaacaacuaccaaaggcucaaucacuucagugcaagcuguuuacgugccagcugaugaucugacggauccagcacccgcaacaacguuugcucauuuagaugcaacuacuguauuaucacgugguauuucagaauuagguaucuauccagcgguagauccccuugagucuaaaucucgaaugcuugacccucgaauuauuggccaagaucauuacgac

SEQ ID NO: 1193 - RNA, 398 nt, Artificial Sequence
  Synthetic
uuugugcaacgauaucacgauugguaaaucggauaacaagccgguacuuuggaguguuguauuuguucuuugccuguguuaugaggcgcuuacgagcauaguagucagucuuuccaauccgacgccgcuuguauuuaguuugguaucgacugaaguaugcugaauuuuuaacuaacuuagugaacggcuguuguuuguuagcucauaauuuucgaauccgcaguucacauuucagaaucaaguccgaacauccugcaaaaauucucaaguuucacuuugcauuucugcgcacuuguaucaaauauuaaaagauuuuaagaguuuggauuuaaauggaagaugccuuaacuuaccauccuuuuguucuggcugaagcuugcugacuugaguuggaccgg

SEQ ID NO: 1194 - skipped

SEQ ID NO: 1195 - RNA, 275 nt, Artificial Sequence
  Synthetic
auaacuuuuggcguuuuuccaaggccucuuucucccuucgagcuuuggucuuguuacucccagacggagcaacuccauuuaaaaucuucugggaaucuucugggguauaguuuacgaagcuagugguuccuuuuucaauaccacuacugcaugauauuuccaaagacuuaaggcucuuugcagaccuccguuuacguaauuguaagcauggugauaaacuacgguauugagcuguuuugugucgauuuauuuuuuuuuuacguugauaugccgaa

SEQ ID NO: 1196 - skipped

SEQ ID NO: 1197 - RNA, 391 nt, Artificial Sequence
  Synthetic
ccuuuuuagcuuuugauccacgcaauuucuucuuaggaagaucacccuuugguuuuugcgaguaccgaauagcagacgcacgagcaacagcuucagcacgaagaucagaucgauaucuugauuugacaacaguauugacaacccccuuauauguccgucuugaaguuuuauuaccaccaaaaacuguuguguauauggcgcuagaagguuuuuggguaaauuuaguuuuuuuggugaucaaaguaauaccuccuuuaccaccuucaaugggaagaauuccgacagccuuaucguuaacaaauccggcauauuugcgagaaugcacauuuguuaaguuuaggggaucacgagaaaauuguacaccuccacuagaugcacguuugacuaggaa

SEQ ID NO: 1198-1199 - skipped (2 entries)

SEQ ID NO: 1200 - RNA, 240 nt, Artificial Sequence
  Synthetic
aagaagaaaaagaagaagagucugaugaagauaugggcuuuggucucuucgauuaaauuaauucguguauauaaaaaauauauucauaucaaaaguaacguauuuaauacuucauacguuggggcaagcuuuaagacgagucuucuaagacccuaaaucccagaucuauaaggguccaacaacgugaauaucacauaaaauacucaaucaaauucgcuauaagagaaaauaauuucucaa

SEQ ID NO: 1201 - skipped

SEQ ID NO: 1202 - RNA, 339 nt, Artificial Sequence
  Synthetic
aacagauagcgacuuuaacguaacgcgacuucaaagaucuuuucucuuaaaccaauuuuauugcacagucuuuauaauucacuguccguuauccucuaacauggcuucaacacucaaaucaaucaagucccuugcuccuuuacuugaccggguucuuguacaacgagugaaggcagaagcaaagacugcgaguggcauuuuucuucccgaaaaaagugucaaggaacucaaugaagcccacguuauagcuguaggaccuggugcaguuggcaaagauggaaacagagugucuuguaaugucaagguuggcgacaagguucuaaucccccaguauggcgg

SEQ ID NO: 1203 - RNA, 398 nt, Artificial Sequence
  Synthetic
uaauuuuuaucacaucauuuucucucccgaguauacuauuaauauacuacaccauugaaagagauaaauauuacuacuugagucaucucuacagaagaaaucaggcccaaaauuacacucugugaccuuguaauauuuuaaaaugccaucagcuacuccaaaugauacuacgaaaguugggcaaucagccaaugauaacaucugucgguuugcugcuccuagccgcccauugagcccucacgcaacucauacacucuuccaugauaaaacaagauguuucgucuauggucuucagccuagagcuguucaaggaaugcuagauuuugauuuuauuugcaagcgaucuacucccucaguugcaggaauuauauauacuuuugguggacaguuuguuagua

SEQ ID NO: 1204 - RNA, 380 nt, Artificial Sequence
  Synthetic
aaaaccaagcaggaguaugcuaagcucucucaguugaaaaauuuuccuugacauaaaacagucccugucuuaacacuccguguggacuuucauaauuagacuuaugccucuauuuuaaaguggaugucuuuugucaaucaagauauuaguaacugcuaugccagcuggcuuuauccuuuuuuugguauugucgcauacaauaaaaagguuuaugaugaaggugucaaaaaaacaaucgauuaugcucaaauuuuugaggauacucuucaaaacaacacauucuuaguuggagagcgucuuacucuagcagauauauucacugcaaguauuuuaaguuuaucauuuagguaucucuuugauaagaaauggcgagcugccaa

SEQ ID NO: 1205 - RNA, 369 nt, Artificial Sequence
  Synthetic
uuggcuucaauguaaagaacguuucggugaaagaaauccgucgugguaauguuuguggugauucuaagaaugaccccccuaagggugccgagcauuuuaccgcacaaguuaucguguuaaaccacccaggucaaauuggagcugguuacgcaccuguacuugauugucauacggcucacauugcuugcaaauuugcagaacuucuugaaaaaauugaucgucguacuggaaagucuauugaggcaacuccaaaauuuguuaaaucuggugacgcagcaauuguuaaaaugauuccaucuaaaccuauguguguugagucauuuucaaguuauccuccauuaggucgcuucgcuguucgugauaugagac

SEQ ID NO: 1206 - RNA, 395 nt, Artificial Sequence
  Synthetic
uauaauuuuuuuauuaaucucuauuaagauaaaucauuccuuaucuugauucuaaaccucagccuuaauggcaaauuuucucugggggaagugggugagccuuuuggccguuuugucuaaaauuuuggaacuuucaugcuucguaagacgucuccgaaucgcucguguuugcuuuggacggaggucaagagguagguauuuuuugccuuuauaaaauaaucgaaguugugaacguuguuuugaguuuauuauugugagaacucuugcaauugauuuucuuaugucgugaauuuucguuaacuuugaagcagaaccuccagcaaucuucugaguccguaauugaccgaguucuguuuuaagcucuccuaauuguuucguaaggucggcuuuguuuu

SEQ ID NO: 1207 - RNA, 386 nt, Artificial Sequence
  Synthetic
ucaaacgaaacaaaaaaucuucucagacaaaauucaaaguucgcugucagaaauacuuauacacucuuguguuaaaagacucugagaaaguugaaaaauuaaagcaaucguuaccuccaaauuuagucaucgccgauaccccuaagaagaacgcgaaaggaaaacgaaccgcucaauaaaugugaaacuaaacucuuauuaagucuugaguaaauauacugaucauauacgcaacuauguuaaaauaaauagaguaacauauuagcaacaagaaacuguucgagcaaucuuuauucggcaugauucucugucuucauauaucuuauugaacucaauugaaaaacugugaaaaucaauguaaauaaugauugcagcuaugccacacc

SEQ ID NO: 1208 - RNA, 398 nt, Artificial Sequence
  Synthetic
aucacccguuagugauuuaccuucagcaaggguuuuaaauauagccuucucgauuuuuugugcguagcuuuccagcuccauaugucuuaacaucauaauggaugagaguaggagagcaguaggauuugcaagugcuuuacccgcuauaucaggugcugacccaugaacagcuucgaaaauugaacauuugucgccaauauucccugaaggagugagaccaaguccaccaauuaagccggcacacaugucagagagaauaucuccguauagauuaggcauaacaaggacuuugucauuauagggggugggaucgguaacaaucuucaagcaaguauuaucgagaaguucugcaucaaacucaauguucggaaauuccuucgaaacacgcucugcuguag

SEQ ID NO: 1209 - skipped

SEQ ID NO: 1210 - RNA, 398 nt, Artificial Sequence
  Synthetic
ucccaucuguguaaucucuguucuccauauaagcuccagucuuugggcuucuaaauuuauaaucaaaaaaauaugagugcugcuacaggagacuuuggccuuaucggucuagcugucauggggcagaaucuaauucugaaugcugcagaccauggauuuaauguuauugcauauaaucgaacuguagcuaagguagaccacuuucuugaaaaugaggcaaaagggaaaucuauugaaggugcucguucuauccaggaauuugugaguaaacuaaaaaaaccacgucguauuaugcugcuugucauggcuggaaagccuguugaugauuuuauugaaacauuauugccauuccucgaucaaggagacauaauuaucgauggcggcaacucacauuuucc

SEQ ID NO: 1211 - RNA, 388 nt, Artificial Sequence
  Synthetic
ugggucaugaauuucuaggccaucucaucagaaacaucugauaguaguaaaauaccacugccaauuaauaguuguggugguugaaugauugaaauauugauaucgggucuucucaguuaagaaacguacaacuuauucgcaccagcaacucauaacauacauggcucccaaaaagacuucucgaccugcucaggaaaauauaucucucggaccucagcuccgagaaggugaaucaaaugucuuugcaacggcacgaauauuugccagcuucaaugauacauuuguacacauaacggaucucuccggucgugagacuauaacucguguaacugggggaaugaaaguuaaggcagaucgcgaugagucuucaccguaugcagccauguug

SEQ ID NO: 1212 - RNA, 393 nt, Artificial Sequence
  Synthetic
aagaaauuuguauauuaucucaguaaaaggaauuggugcgcgcuuaaaccgucuaccagcaggagguguaggagauaugguaauggcaacgguaaaaaagggaaagccagaucuccgcaagaagguuaugccagcaguaauugugcgacaaaguaagccauggagacguacagaugguguuuucuuguauuuugaagacaacgcaggagugauugucaauccaaagggagaaaugaaaggaucugcuauaacugggccuguaggaaaggaggcggcagaacuauggccgcguauugcaaguaauucuggugugguuaugugaauuauaggcuuuuuguggaguugucuagcauuuguccugcucuuagucccauuaugauuuauggacccgac

SEQ ID NO: 1213 - RNA, 398 nt, Artificial Sequence
  Synthetic
auaauaagauaaacgaaauuugcuacccucaaagaguaucuuuggccaacucucuccucaacuuuacacauccucaacuauuuacguucacaucaaauaaaaguucucauuagaucaaaauaugguuucagcuaugaaucaccuaaccagcucuacucgcauugaauggcuaucacaacuugacacugaguaugccaccucuaagaauuaucgucgaaccucgauuaucuguacuauuggccccaaaacuaacaaugucgaggccuuaaauggacuucgaagagcuggucugaauguuguccguaugaauuuuucucauggcucucaugaguaccaucaaucagugauugauaauacacgugaagcuguaagaguacaaaguggacgucccguugcua

SEQ ID NO: 1214 - RNA, 397 nt, Artificial Sequence
  Synthetic
uacccacugcuaauguuuccguuguugacuuaacaugccgcauuggaaagggugcuacuuaugaccaaauuaaggcugcuaucaaggaggcugccaauggugaauuaaaaggcauacuuucuuauacugaggaugacaucguuucaacugauuuaaucggugauaaucacucauccauuuucgacgcgaaagcuggaaucucgcucaaugacaacuuugucaaacucguaucaugguaugauaaugaaugggguuacucucgccguguuuuagaucuccuaaguuauauuuccaaaauugauggagccaagugaagugguuguuagauuuuuuccaaaaucucaauuugaaaacuagguuuucuaauucuguuacuugaggauacauagcuuuaaaa

SEQ ID NO: 1215 - RNA, 250 nt, Artificial Sequence
  Synthetic
gaagaugaagaugaagaugaugaugaugaugauguuguaguuguuguagaugcaauccguagagccagcugcagaacuuuauacuacgaggcagauucccauaaagcccccuuggagcgagguucguccuagcaacaguucuuugggcaugaucacgagcacgauuccaagguagaggugcccaguaaaauguaaaguugaucgguguaaaucccauaucaagaucaugauaaagagcggcaaaagauga

SEQ ID NO: 1216 - skipped

SEQ ID NO: 1217 - RNA, 354 nt, Artificial Sequence
  Synthetic
aaaacguagaagcuuaugaagguggagaagaugaagaugaagaugaugaugaugaugauguuguaguuguuguagaugcaauccguagagccagcugcagaacuuuauacuacgaggcagauucccauaaagcccccuuggagcgagguucaaugaaggggaaggggaagaggaggguacgagcuuggauuauauucauauaaguccuagcaacaguucuuugggcaugaucacgagcacgauuccaagguagaggugcccaguaaaauguaaaguugaucgguguaaaucccauaucaagaucaugauaaagagcggcaaaagaugagucaaaauucucacggaccucuucuc

SEQ ID NO: 1218 - RNA, 401 nt, Artificial Sequence
  Synthetic
uugaacaugcaaaaacguagaagcuuaugaagguggagaagaugaagaugaagaugaugaugaugaugauguuguaguuguuguagaugcaauccguagagccagcugcagaacuuuauacuacgaggcagauucccauaaagcccccuuggagcgagguucaaugaaggggaaggggaagaggagggggguuguugacguuuucucuucucuacgagcuuggauuauauucauauaaguccuagcaacaguucuuugggcaugaucacgagcacgauuccaagguagaggugcccaguaaaauguaaaguugaucgguguaaaucccauaucaagaucaugauaaagagcggcaaaagaugagucaaaauucucacggaccucuucuccuuguaaggcau

SEQ ID NO: 1219 - RNA, 398 nt, Artificial Sequence
  Synthetic
aaauaauuuuugauaugaguggguaaauauucgggaaucgacugagcccaugcuugcauuucuugacacacuuucugaauauauguugauggauuuguuauaaaaucauuuuuggauugaaaaagcucgugauaccaugaagacugaaucuuucgaaguuugaauaaaagugaggauugaaucuugaauuuccuaccuaguuuuaauuuggugucgacugguaauuucucguucuuaauggaugggaaaguaacgcuagucgaaucgucgguaaaugaaaaagagcgcgcgugaaccauacugacagaucuaucaagagaguaaauacuauaaaauaagguucuccucagcuccagagacuucugaucgguuggcucaucuuuagguggauccuggug

SEQ ID NO: 1220 - RNA, 388 nt, Artificial Sequence
  Synthetic
agucaguucgugaacgcuucauauaccucuuaaugcaaugauugagcuugucuaaugucggagguggaugagacugaacaagugaugaugaggcaaaaugagaacgacucuuguacgcacugaggucgcagcaugauuuauuguaucgggggagaugacaagcguuugaugagugauucccuuccacccuaauagcagcagaagccaaaagauucauguccaaguuaaaaauuccauuuccauugccaacacucuuacuacuacaaugugcauuuugucuagccacuggauuuucuauaaauggcagacuggaaucaggcguuucuguucguacaaaagaugaaaaggaaguuguuggugaaagguuuggagaggcaaugguugauac

SEQ ID NO: 1221 - RNA, 327 nt, Artificial Sequence
  Synthetic
aaauaauaaaaaagaaauucagucuaugaauguacacaacauguuugccgagcugaauagaaucaaaacugaggugccugucuuucaacacaucaacggaggcuuagagaguauuagcgugcucaugagaagaaguagagacagaaguaucgugagaguaguccugcgucuaagagggagauuggaacucuucucgguugaagucgaaggcguggcugcaaucaaauuucguaacucaauccucucaaugaccuagcuugacaccuuuauagugguagggcucuucagaguaaccuccaguagguguaggguaacuggucccuguug

SEQ ID NO: 1222 - RNA, 250 nt, Artificial Sequence
  Synthetic
cauguuugccgagcugaauagaaucaaaacugaggugccugucuuucaacacaucaacggaggcuuagagaguauuagcgugcucaugagaagaaguagagacagaaguaucgugagaguaguccugcgucuaagagggagauuggaacucuucucgguugaagucgaaggcguggcugcaaucaaauuucguaacucaauccucucaaugaccuagcuugacaccuuuauagugguagggcucuucaga

SEQ ID NO: 1223 - RNA, 300 nt, Artificial Sequence
  Synthetic
aaauucagucuaugaauguacacaacauguuugccgagcugaauagaaucaaaacugaggugccugucuuucaacacaucaacggaggcuuagagaguauuagcgugcucaugagaagaaguagagacagaaguaucgugagaguaguccugcgucuaagagggagauuggaacucuucucgguugaagucgaaggcguggcugcaaucaaauuucguaacucaauccucucaaugaccuagcuugacaccuuuauagugguagggcucuucagaguaaccuccaguagguguaggguaa

SEQ ID NO: 1224 - RNA, 350 nt, Artificial Sequence
  Synthetic
uauuuggaaaaaaauaauaaaaaagaaauucagucuaugaauguacacaacauguuugccgagcugaauagaaucaaaacugaggugccugucuuucaacacaucaacggaggcuuagagaguauuagcgugcucaugagaagaaguagagacagaaguaucgugagaguaguccugcgucuaagagggagauuggaacucuucucgguugaagucgaaggcguggcugcaaucaaauuucguaacucaauccucucaaugaccuagcuugacaccuuuauagugguagggcucuucagaguaaccuccaguagguguaggguaacuggucccuguuggcgaugcguaac

SEQ ID NO: 1225 - RNA, 398 nt, Artificial Sequence
  Synthetic
gugucuuuuuguauacauccacuaaaccguugaauuggcgcucaccucccgauuucgcgcuuuuguuaucauuugcuaaucuaguacgagcauaaucuaaugaguagacaaaaagaagagaaguagcaccggcagcuccaccagaggcaagauuaccagccauccacuucgcauauccaucacgguccuuuuugaaauugaacauugauuuguaagugucucggaaagcgaaauucaaagcuuggguaggaaaauaucggaucacauuggcuguguucccacgccauagcgaagcaacaccuucauuugccguaacucgcuuaaagcaaucuaaaauuccaucauauuuuuuauccaaacguccugauuuuaacauuucuuccugauucuggaucaau

SEQ ID NO: 1226 - RNA, 398 nt, Artificial Sequence
  Synthetic
uauuuaauaaauucauugccugcuuucgcauuuccacucuacccagaauacgaacuuacagcacuucgcaucuuucuacuucccuuucucaucuccaaucauuuuucgucgaugcagaaaaauuacuagaaaagccauaauuaauaucuaaagaaaaaggaguuaaaacaaaccccaaaaauauuaaaaagcaaagaaggaauaaauucuugaucuauucuuuuucuugacauauucacuauguaaaagaaccuccccucaaucgcgucuauuaccucucaagauuuccgaagcaauaaauuauaaaaggcauauaucugacgagaaguaaaucaaucagaauagucuauaucacagcaacgggacgauaaauuaagaucucuuuagccauccgucuu

SEQ ID NO: 1227-1229 - skipped (3 entries)

SEQ ID NO: 1230 - RNA, 398 nt, Artificial Sequence
  Synthetic
aaaagaugaccaaaaguacuugauuguaguugcaagcucagauaaaggauugugcggcgguauucauucaggcuuaaguaaacacguucgaaaaaugcucucugaaaaccccaaugccgauauugugguauugggagagaaggcuaaggcacaauugagucggucaaguaguaaaaauauuguuuuaaguuucucuggcguagggaaagauauuccaaccuuugcagacgcucaaacaauagcagaucaaaucucucauuugccaagugaauacucaucuacuaaaaucguuuacaacaaauuuuugaaugcucaaagcuacgaaccuacaguuauacaggcuuucuccguagaagcaauaaucaacucgcccaacuucucugcuuuugaggucgacg

SEQ ID NO: 1231 - RNA, 398 nt, Artificial Sequence
  Synthetic
auauuucacgaaaugauguuacggcaagguguaaaacauauuuucgguuauccugguggagcaauucuucccguuuucgacgcuauuuauaauucaaggcacuucgauuuuauucuaccgaaacaugaacagggugcuggacauauggcugaaggcuaugccagagcuaguggacuuccuggggugauucuaguuacuucuggcccuggugcaacaaaugucauaacaccgaugcaggacgcucuaucugacgguacaccacuaguaguuuuuugcggccaagugcccacuacugccauaggaagugaugcauuucaagaggcugacguuaucggaauaucaagagcauguacgaaauggaaugucaugguuaaaaauguugcggaauuaccgagaag

SEQ ID NO: 1232 - RNA, 398 nt, Artificial Sequence
  Synthetic
auugaaugauaagguuaaguacuuauauauucaucaaugaaagaucaacuuaacuaucaauuuuuauuugauaacuaagcuagccagaauuuuaauucgggcaaguuuaguaauaugaaguauucauucgggcuucgauaauuaacucugauuuuugaaccaagcaacugaccucucuaugccuucccacagguggacuucugguguauauccaaguagccucuuagcuuuacuacagucauaguaucuugucauacagcuauaucguacuugccuccucguuaagcugggaacuuuucccauaagcaugagcaaauuuucuaaaauuccaccaauuaucaugcccacgcucuggcuuauuucccagacguguucugugcccuugucacuaccagcag

SEQ ID NO: 1233 - RNA, 398 nt, Artificial Sequence
  Synthetic
auuuuuuuaauucuagaaaaaugacgcugauugacuauccuuccaaaaucuggacuauuucuuauaccauuuggauagaauucauuuagaguguuuuucaaaugcucuacgaaaauugguaaaacuucuuguucgacaagaauauaauuuugacugaugcaaacuuguccagcauucauuaguuuaccccauaauagccgacgagcagcaagguaugggucugcauuuuucguaaugauugccggauugauucccccgagcucuaagcaaacugguguaagaguuucugcagcuuuuuuggcaauuauuacaccuacuuggguauugccaguguaaaauauuuugucccauuuuucguuuaguaaagcuguuguuucaguuacagcuccauucacgau

SEQ ID NO: 1234 - RNA, 397 nt, Artificial Sequence
  Synthetic
aauguuugcacuuucaagguuauuagaagucuggggggaucuuguuacuugagacugugauuuuggaguauuauuugauauuugcgaugcugguguuguauuuugauggacggaguuccuugucgugacagacugagaggauuggacugcuaguugccuuugaaaugcuuguucgucccuccuuaaagguugacuacuuaaggguuggggaagguccacguuuggaucccuuccuauaccucucacccuuccucuuccucuauuacuuauguuuccucuuuggccaacggcgucucuucuuucuugcauauagggcugucgguaggaaaagucugagaggucaauauuucucaaaucucgaagaucauccuuagauagggaacuaccaugaaccucg

SEQ ID NO: 1235-1236 - skipped (2 entries)

SEQ ID NO: 1237 - RNA, 374 nt, Artificial Sequence
  Synthetic
auauauaaugaaagcuuuauguugugggugaaucuuuuaucaucuucagggaagacgucgagauauaauucuguaguuuugaucaguacucugugacuuguacugacguuuagucacuacaugaaauccuucagucaccagauauuuguuuuuauuuuuuuaauuuacauuuuguggauccagcgaucaucaauauuccaccugaaaauaaaaaauaaaccuaggagcagguaauuucacaacuacuugcuugcuaggaaagagcuguucuuccgagauucaguuacgucuauaaacguuaagcuucuucuuauaccaccuuacuuuuuggaugauuugggcauuuugacucuagaucuaacuggacaguccug

SEQ ID NO: 1238 - skipped

SEQ ID NO: 1239 - RNA, 384 nt, Artificial Sequence
  Synthetic
auaaaaugauuugauaauacgguaucaaucaaaucuacauuagauaccagccaaauaaauuccaauaaauccuaaacgaaucuuaucauauauaucaaauaacaccaaacuaagaugcugguuuuaauuauuucggaaacgucaauauacuacacuaacacccuggagauuuagcuacguugaauacuaaguuauuucucgucuuaaccagguugaucugcuuugcaaaaacauguauugcgacugauuuuuauggaguagcucuuguacuuagucaguuccuaauggauguuuuugugcuuucgaauuuuaauagguuaugacuuuagacuugaggcuuucuguuguaaugugacucacucauaggcucuuaggucucaacac

SEQ ID NO: 1240 - RNA, 392 nt, Artificial Sequence
  Synthetic
aagcucuugcaugauaaaggucauuuugaugaauuugccucaaccauucgugaauauggaaugcauuaugaugauuuagagauuauucuuaagguuaaaggaugccuaugggcuguagguaacguuggaucuauggaauugggugcuccuuuucuugaaaaaucagaugucgugcagaacauaauuaaaauugcagaaucgcaugaaauaaugagcaugagaggaaccgcauuuuucguacuuggccuuauuucuagaagcauucauggucucgagauacuuucugaacaugguugggauagccauacaacuuuuaugggcgugucauuaggucuaugcaucccuacuaaucuuaguaaauuuuuuucuuaugaaccauggcagcaugauaa

SEQ ID NO: 1241 - RNA, 394 nt, Artificial Sequence
  Synthetic
caaucgguauuacggucuuuguaacgacgacacaaauuaauuaaugggauaccguguugaauaguguacuuuucggcucugguugcaagcuguacaaaugcaaaaggaagaaaaugaccguguguuaaucuaaucuugggcugcugcagcccaaauuuuuuagauccauugcaauuguagacaggauucgggacccaugcauauuuaaggcguucuuuuccaauauuaagccgacaaugauauauugcacaggagaaacaaagaagauguuuagguaauucuuuaucuaaagucaugaggaaucucagcuuuucaucuugauuucgaucacuuuucaaauagagccaauacuucuuaucuauucgacuuaaaagaguuuuacuagauauugcaa

SEQ ID NO: 1242 - RNA, 344 nt, Artificial Sequence
  Synthetic
auggccaguccacaaauaucguucugccuauuuuuagagcaucuccgcuuaguuuuuauuccucaaggcagcuaaauagcucuaguuucugcuuuaccccucauucaaaucucgacuuucauuuucaagucuuuuacagaauauauuuuucuucaaggcgucuccucacuuuucauacacuaauuagacuuaaauuuuugcccuauugcagcuaugccggcucaaaacucuggaacuuuucuuuucacuuccgaaucugugggagaaggacauccugauaagauagcugaucagguuucagaugcuguucuugaugcuugcuuagcagucgaucccuuguccaa

SEQ ID NO: 1243 - RNA, 398 nt, Artificial Sequence
  Synthetic
uuugacaagacaguacuauaaucucggcaccgaucuuuacgaauacggcuggggacaaucuuuucacuucuguagauuugcuuacggugaaccauuuuaccaagcgauugcgcgacaugaacauuaucuugccgcuaagauaggcauuaaugaggcagacaaaguacuugaugucggaugugguguuggugguccggcaagagaaaucgccaaguuuacuggcgcucauauuacuggcuugaacaacaaugauuaccaaauagagcgggccacgagauaugcacagaaagaaggcuuaucaaaccaauuaagcuuuguuaagggugacuuuaugcaaaugucauuuccugacaacucauucgauucaguguaugcuauugaggcuacaguccacgccu

SEQ ID NO: 1244 - RNA, 396 nt, Artificial Sequence
  Synthetic
cuucccaucgauaucaauccauuuuuccauuugagcuuuaucagcauccgauaaaauacgagucuguuucauauguaccucacgaucaucaccauuggcauagcgccauugaagauauugguuugggguuuucucgagaugcauuucaacauguucaagugcauguuguuuuauauauccaauucgcaaauuaggguguuuuucgacucgcccagaaguagggaccgucucgccaguaaguaguuuuauuaacguugauuuuccugcaccauuaccaccuaugauugcaguucgagaugaaagggagaguugacaagacacauugugcaaagacgguuuugaagcgccaggauaaguauaagaacaauuagucauacggagaauugagcgaguuug

SEQ ID NO: 1245 - RNA, 398 nt, Artificial Sequence
  Synthetic
acuauuaacuuuacugaggcgaguugaucuccguauugaaagucgagcaguucggucaauuucuucucuaggaugaucagggaaauaugugguuaaaucugauguaauuaauucacuugggggucuagcaccaaagaauugucggagaacuccuugucuuucacuagaucgcacacgguuauaaucugaggauggcucauugauagauggaggucguucuaaguccuuugcugcacuacaaacauuucguucucguuccuuuucuucguaagucauguuggagaauugugaaggugaugcgggaugauuugagucagacuuccaauguucacuaauaaucuuagguaaaacugguguaauuuuuucuucaagauuuuuuguaggacgauuuuggagcg

SEQ ID NO: 1246 - RNA, 386 nt, Artificial Sequence
  Synthetic
uaaguggcuuaagagaaacaacaguguugcaauacuaguuaaacagaacaucaaaauaugaguguccggcaaaaauucucuuaauuacgcuuuuauauaaguuggcguauuaauauuccaaaaauuuuuguucaguucaauucauuuaacuuucauuucuuuacggauacuaaauuugggcuugaauuuuugauuuugauuuuaaugguuaacauuuugguugagucagggcauuuggaagagaggggauuaaagugagauguugauaucuuuaaaaucauuaaauccuaacucugguuuucguaauuaaagaaaaaaucucucagauuuuagauuuuucggaagaaaacuugggcagaaauaaauacuaggaggguuacagcgaa

SEQ ID NO: 1247 - skipped

SEQ ID NO: 1248 - RNA, 398 nt, Artificial Sequence
  Synthetic
aagaagucugaaguauuuucaacuuacucugacaaucaaccugguguucucauucaaguuuuugagggugagcgacaacgaacaaaagacaacaaucuacuugguaaauuugaguuaacuggaauuccaccugccccacgugguguaccucaaauagagguuacauuugacuuggaugcaaacggaauuaugaauguaucagcccuugaaaagggaacuggaaaaucuaacaagauugucauuacaaacgauaaaggacgucuuuccaaggaggauauugagagaauguuguccgaagcugaaaaauauaaggcugaugaugaagcugaagcaggcaggauuacugcuaagaauggauuagaauccuaugccuauucucuacgaaacacucucacuga

SEQ ID NO: 1249-1250 - skipped (2 entries)

SEQ ID NO: 1251 - RNA, 357 nt, Artificial Sequence
  Synthetic
aacauaaugacaauauaguucauagucuuugauuguauuuauaccguuggcauuuugcucugaauuuaaagcauaaucagccauuccauuucccauuuucucuguaauguccuuaauaaugguuugguauacagguuugaucaaugcgaauucgauuguaacaacaucaaagugaacaagaaguucucuauccuuuucuaagggcccguucccaucaaaauuccauucuuuuuucccaauuacaucauggaaguuccuuaguaauggcuccuuuuuuucaauugguauugucauaucaucuucgauugugucuagaccucguaaaauaagauagaaaagcguuacuggaacaaguag

SEQ ID NO: 1252 - skipped

SEQ ID NO: 1253 - RNA, 398 nt, Artificial Sequence
  Synthetic
ucaucccguguuuuaauugccacugaucuucuugcucgugguauugauguacaacaaguuucauuaguuauuaauuacgacuugccugcuaaucgugagaauuauauucacagaauuggucgagguggucgauuuggacgaaaagguguugcgaucaacuuuguaacagcugaugauguucggaugaugcgugaaauugagcaguuuuauagcacucaaauugaagagaugccuaugaauguugcugaccugauuuaagaguugggucacuuccuaccacaacgggccggcaccagagugagaaauauuugauuuuauuugauuauauauuaauuuucauugcaaaucaaauguuuuucaaucaguucgauuuaaauuagaucauauuagucuuuuau

SEQ ID NO: 1254 - RNA, 398 nt, Artificial Sequence
  Synthetic
acaaaucuauaaaagucccaucucuacugcugauuuagcuaaucgaaugggucaauacuugcaauuguacacccuuuacucuucuguuaggccguuugguaucacagcuauaaucgcuggaugggacucagaaucugaaauuccuguugauagcgaaguuggaagugguccagagauuggcucaggcggaaaagcugaggguaagaccuauggugguccaggacuauuuaugauugagccaaguggaucauauugggguuacuauggugcugcuacugguaaaggacgacaaacugccaaggcugaguuggaaaaguuggaucuugcaucuggcacacuaagucuacuugacggagucaaugaagcugcaaaaaucauauaucuagcacaugcagaua

SEQ ID NO: 1255 - RNA, 398 nt, Artificial Sequence
  Synthetic
agaaaaugcgauauuaauccccucuacgucacaaguuucacuauaaacccaacuuuuuggcuauggggugaaggcuuugagucauuauacauauuacuuauuuucuaucaugcgaauggaaugcuuuauaugucauauauaacgagaaaugacggaaugaacuugauguaauuugauaagagaagaguacaaaagauaucacuaggguuugaaugauuaaaauacgaguacuauuuauuauacauagagaaaaucuaucauuacuuucaugccucucacaaauuagaguaguuagccgccugggaaauucgccaugaaagaugaguaggcuuaugacaaacauucauccguacaagcuuguaauucauguaaauagauuacuacuacucuguacucaa

SEQ ID NO: 1256 - RNA, 398 nt, Artificial Sequence
  Synthetic
ucaaauuuggcuuuuucauccauugacaaaggcuugugguauggauguuggugucccauuuccaucauuaaaaacuaugugucuucagauugcuuucuuuuucguguuggaagauacguggcauuauuggaugcaucgauuauuucauugggguccuuucuacaaacauauucauaaaauacaucaucauuacucugcacccuucggacuagcagcugaauaugcuucaccaauagaaacaaugguucuuggcgcaggaacagucuuaaugccaacuguauggugucugauaacuggcaaucuucacuuaguuacgauguauuguuggauuaucugucgacuauuccaagcuauugaugcucacucagguuaugaauucccauggagcuuacaucauu

SEQ ID NO: 1257 - RNA, 396 nt, Artificial Sequence
  Synthetic
aaucuaucagcucuaaagcauagaauuugcuuuuuacgaugggugacuugucuauauacugcuuucggaauuuagaugcauauccaucggcgauaauugugagaucucccaaauaguagucggcuucucuuuugccuguuuuaucauucauugucucugaccuuacgccaauuacaguuuggguuugaggauucguaauagucucuguaaccagcguuucaacaauuuugauguucggguucugggagcagcaucuacggagcugagauauuagucuaccauggugaaaagcucguccuuccggauuaccgcccuuaauguuuguauauccaugagcacucgcauuaucgguaucugccuugggauaagguauuuucacgccagugccauaauaaa

SEQ ID NO: 1258 - RNA, 397 nt, Artificial Sequence
  Synthetic
uauauauugauaaauauauccaacucuagccgaacuaauaaccgguaaauuuuagcuucucgaaucaauuucuaaagacaugaaucuggccagccaugugcuuaaaacuuauuaaauaugacuccuucaacuuucucugguaauaaaagaguuguuaagaauauuguuaccaacucgggcugucuuuugugucucguucaaauuuuaaauauccuacuaucgcaugauuuccugauauauaaguucuuuaaguuguuccuuagucaaauuaucuuuauuuuugucaaaguugaagaauucuucuggaauuggcugggcuguugguucaucuucuggaucaugauaugguucuaaauauggguguuguaaagccucgucaacuguuauacgcuugaca

SEQ ID NO: 1259 - RNA, 397 nt, Artificial Sequence
  Synthetic
cuaggauuccuuuuacauguccaacgacuaauuucucgucuuccucuugguaauauauuacagcguuuggaccugcaucaaaaguauaggccgcaacuguacgguucaaaaugcaauucaaauauucaacuaaucuuaucgucgcgcgggaaauaucguucauauaaaauauugguggguaaguaucaagacaaguugcaugaaaauuauugcuaucugacauggugacuuuagcaaagguuucaaaguccuuguucauaauugcgcuuugcaucauuuugauauuugcuggcacgacaguuuccacacgucgauuaaaaagcucugauguuuuugugguagcuugcauaccugauguugagcuaacauccuuuuuugacccugagaugacaagaau

SEQ ID NO: 1260 - RNA, 394 nt, Artificial Sequence
  Synthetic
aaaauauccaauuaguguuaugaucugaucaaaguuacucccauguuuaacccggcaccgaacuccaugauuuuucgcagacuggcaauuuuuccgauucugucuuguguuuauucuuccaccugagccaguuccggggauucaaguuaaaugugaauuuaguuaauuuagguuucaauauacuauuacuauuaguaauucugcuacuugaugauguauucuuagcuguucggaagacuccaggaauuauuucaacaaagaguggacguaauguagguaagcaugcgcaaaugacaguaacuucgauuucgagaauagaccauacaaguauaucaguauucucccaaguuaggucuguagaauucucaaauguagagagauacuuuaaucggac

SEQ ID NO: 1261 - RNA, 398 nt, Artificial Sequence
  Synthetic
uaauuguuugaugcaucuucuuuuccggugaucauuugcucgggguggaauaagcuacgauaaguacccguacgaacuucaucgacuacauuugguucaagaucacaauaaauaguucuagguacguauuuucccugaccagucucugaaaaaaaagugcugaaaccuucgucagguucggcggccuugcgcuucuccguuaaguaaccaucaggcuguauaccaugcucaaggcaauagagcucccagcaagaguuugcuauuuggcacccagcuuggccaacauuaacacuaauaacuucccucauuuuucguauccaauacuaaagauuuaauaggaggaagguauaauugugagucucuaguugaauucaaagagacgugcucguaagugcuag

SEQ ID NO: 1262 - RNA, 398 nt, Artificial Sequence
  Synthetic
gauauuuaauuuuuuaaaccggucuuuuacuucauuuucaaaaaaugaaaaaugauuugaguugcggcuacaacucauuaucaaaugagauaaaaugacaauacaauugaagacaauucuuugaguuugacugccuagagccucuuacucauuuaucaugcauuauuugacaugauuauauaaagaaacgaccucgaaucuugaugcaguucucaggagguaggugaaauauauaagaaaauagcauccauauggaugcuguaaauugaaagaccaaggcuauuuuucuugguguguguugaaauuucaacuuuuacaugacuuaugaucaucgguuaaaaauuuugcuuugaggaucguguuagcagaugguauauaguuuagucaggacaauaguc

SEQ ID NO: 1263 - RNA, 396 nt, Artificial Sequence
  Synthetic
cucuuuccguugaauuuccaauugcuuagcuuuucucuuucguucuucgguagccucuagcucuuuauuccuugauauuauuucuuguauccuuuccucguggcuuuccauuuccaaaaaagauuuaauuugguugauuguuagauucucacgauaacccugagagacaaucucgucaaaugcacuuaaaagcucguacgcauuuuucaguauuucucucuccucuagagacuuacagauacuugugauaacuuguacgaacacguggaggguaucaauauccugaaggauauuagauugacgauuaguaacaaguaccauguaaagcucgucaagagguugauaaacgaaucggacacuaucuugcucaacgguugugugcugaguuccuguguc

SEQ ID NO: 1264 - RNA, 388 nt, Artificial Sequence
  Synthetic
uauauuuauauauaucuauguaagaggauuaguccuuuuuaauuuucauaauacuuuugacuuguaauuugaaagaauuuuucuauugauacauuggacaaauucaagauuccauaaaauuuaagauaguagauaguacuuuuuugggacaggagaaugauucucccucguuacugaauaucaagguauccacgaucaaaaaacaacagauuguaaauugaauaacauuuuauuuauucaccgggguucugguuaacaaauuugauuccuuuuucgauauucuuuaacaaaucaacuagagcagcuuuuaaaagaccuuguucuucaggagcaagguuucccacuucauggaucuuauuuacgccauuagggccaagcucaacucuac

SEQ ID NO: 1265 - RNA, 398 nt, Artificial Sequence
  Synthetic
uuauauuuuuuucuacuucuuucauucaacaaaccagaaagcaacucguacucuucggacugaguccuugcuggugucaaggcuccucgcagauaucacuucuacuuuaccugcuguguucuaucuagaucggagcaggcuccuuuuaucauacgacaacucacccucuuuuguaaagauucauaauucgaaauuuuagacaacauuaucaauucaucucgcuuaucuucauacauaucgauuauuuuaaucagaguugagaauuacuaaucuuucgacuuaacaauuucuugagggguugaagaaggaauguccaguaccucaaucucuagaaaucuuugaccgucgaucuauaacaucacauuuuuauacguuuuauuuauacaccugauacucac

SEQ ID NO: 1266 - RNA, 357 nt, Artificial Sequence
  Synthetic
uuuuauaaaaguuaucaauuauaaucauauuaugccaacacguuacacacucgaauuagaaggucuuaaaaacguaauaucuacagaaacauucaaggaaguaucgcagcgagaggaugccaagaaagugguuaagaaagccuuagaggagagauauuuaaguggaaagaaucgaugguucuuuacaccacuucguuuuuaaacaaaccugucagacacuacaaauucaugucggaauugggaugaaaugauuuuuucauagguuggugauaaucgaauaaauuuaaauuauauuaaacuagauucacuaaauucaaauauaccuugaaauaugauaaaaucaucugucuguuucuu

SEQ ID NO: 1267 - RNA, 398 nt, Artificial Sequence
  Synthetic
acauucgaauauacacgacuuagagaggauuuacuuccaguuuuucggauggcaaaagaagguaaaccacucccguauccuuccgcaaaaacaaaugguucaaacaguagcaauuuugacaacucaagcaacauuucuucaccagcuucuucaucaccugcaauacaaccuggaaucucucgcaacuauucaaccaaaaaauucuuuaucgaucaucccaaaaauuugucaccgacauaugcgcauucagcucaugaaagauccuuauuagagcaaacucuugaucagucagcugcgucugauagaaauuugcaaucuuacucaaauuuaccuucuaucaguaauaguaacucaucucuaccaucgccaaaucaacuuucaccuacuucaccucuaca

SEQ ID NO: 1268 - RNA, 387 nt, Artificial Sequence
  Synthetic
ggucgauagagucaauggcuucgagaagugucuuuccaguacuacugccagcuuuuguuuccuuugaccaaccuuuguaccaugggcaguuugaugaagguucaaucauauugucaccguugaagccagaaauugguacaaaagcaaccgauuuuggguuauauccaacuuucuuaauaaaauuuguaguuuccuugauaauuucuuugaaacgaucuucagcccauuuagcgguguccauuuuguugaucgcaacaaugagcugcuuaacaccaagugugaaugcgaggagugcauguucucgugucuggccauccuuagaaauaccagcuucaaauucaccguuaccagcagcgaugauuaaaauagcacaaucagccugcgaag

SEQ ID NO: 1269 - RNA, 398 nt, Artificial Sequence
  Synthetic
cacuagauacaacugcucccguugguucugguauugaagcaguauuaacgcuggagauaguuccagauccagauuuagagcaacuaagaucaaauagggguuuugugccagagacaauaccaaaacugggauuaggguagcuguuaucuguaucaucgagaguaaaccaccaaguguugacggccccgaaaauaggacauccuacuugguuccaauaagucuuagcauuuguggcuccuguuucugcauagccugauuuuuucccgcucacuggccagcccguuucugugauccauacaggcuuagccccgacugcauuuuucguaucuaccaaggcuuuguuaaaaaggcuagcaccauuuucuaugcuauuaacuugagugucuugaaaauaugga

SEQ ID NO: 1270 - RNA, 397 nt, Artificial Sequence
  Synthetic
caaaacuuguuaaaaaauccuucaaguccaauaacguuuuaucaucugccaauauuaucaaaguaguaaauaacauuuucaucuugagauuuucauauccuaaagauuuuggaagauaauuauguuguaacuuuacuuaggaauucccguuuuccuuacuucagugcagugcgagcaaauguugguaaaaugaaacuugcuuugugaauaucagcguuauaguagcgaagcagcuucucuucuucuucagcacuaaaagaucuuagggguaccuugaggucuuguucgggaucuuugcugcaaacuagaaacccgauuuggccagaaggauauguugguauugucguauaugcauauucuacguuaggaaagacuucccgacaaucuuuuuugaguu

SEQ ID NO: 1271 - RNA, 350 nt, Artificial Sequence
  Synthetic
ugcaucuauuacugugugucuagcugcugcgcucuuauuacagguaagagcgcuuucugggccucaugaggaccaacccauugaagaagcacauacccaaauaagccgcauuaauaugugggcuuauguaggagaaauauguauccauggaaacccuucaggaguagauaacacuguugccucccaaggaaaagcuguuauauuucagaggcccgacuauucaaaggagccaaucauaagaucuuuaaugaaguuuccgaagcuuccucuccuuuugauugauacaagacaaccaaaauccacggcagaucaaguuaauaaaguagcgacguuacgaaaaacucacccag

SEQ ID NO: 1272 - RNA, 391 nt, Artificial Sequence
  Synthetic
ucauuaaaacuaguacuuucauauguugucgauuggcugguaguuauauuuggugcauuuuuuggauuauuuguuggaucgaggguaccaaacaaaagacccuucucgcuggagaacccagauaucagcuuucccuauaaaacacaugaaaaagucucgguacgauggcuuggauuauaugcuuuuauaauuccggcauuaguuauuuuugcuauuugcuuaguucuuguuccuggaccgacgguuacaaagucaacgccuagaucugccauauggcaucggagaaugugggaauuacacguuggauugcuuggauuaagcuuuucacuaucacucaccguucuuauaacgggaggaaugaagaaucuuuucggcaaaccacgaccagauc

SEQ ID NO: 1273 - RNA, 394 nt, Artificial Sequence
  Synthetic
aauuuauugcaaaccuaauuaaauuuugguggagaauauauucaaaucuggaguuauauucaaguuguauauaguuagaagauguuucaauugcuuuaauaacuaggagugugaaaagagcaucuguugacgucgcguagugcaauuauauagcaaagaagcuuagugacugguuuuaugacaaaauaucuuugaaaauuucaucaaguaccuaaaguagaucgaaaagcgagaucaaacguugcuaguuucucgugugauuaguacuugaaucacaauguuugaaguuacauuuuaagauuaagauuggguuagauuggauugaaaacuauuuugauuuaauuuuauuugauagaaaaaaauugaauugaauugacccuggccauaguaccaa

SEQ ID NO: 1274 - RNA, 398 nt, Artificial Sequence
  Synthetic
uuaucaugaucaaaaaaggcuauaugcuguuggaguacugucugaugucgaugacgguaugcguaaucuccuuuuacagugccacguggagcuucguaugaagcggcuucauucgcucuugcaguuccugcuugcuuuaauuugagauauccuuccuuuugcacaaauggcuuucguuccucaguuacugauaccucuggaauagaaauaucaaauccuucaccauuagcuucaguuuuaaucauauugaaauauucuuauggucuaagcaaaucaauuguuuuuagagaaguugaaaggguggaaauuuuugcgaaaggaaaugugaggauaguuaaaggcucccucguuguugagaaacauaucuaagauuagaguagccucggucauguucucaa

SEQ ID NO: 1275 - RNA, 313 nt, Artificial Sequence
  Synthetic
uuuucaauaaauaggaaaaaaaaggauagcuaauuucauagcuuaacccuuuaccaauauuaguuccuuuuuuuaaugaguauaaaaaucgaacuaguucuaccucuauauuagauuaccaauuuauuuucaauauagcugagcucauuuacacaauuagaauuucaaaucucaauauuuuucucucaugcuauuuguugauaucauugaugggugugugcuaaucugagcagguguauuacuucuuguaauaggagcacuucuguuaugugccauauggcucuugacuaaauggccugcugcgagagcacug

SEQ ID NO: 1276 - RNA, 396 nt, Artificial Sequence
  Synthetic
uuaaugauauuagaggaaauaacaaaauuuacagagaacugugauguaucgucaucaacuucccaaacuaaauagauauuaauaucuuagccaugguguaucucuaacacacaauucaucaagguaagacggguaaaucuucuaauuauuuccagauaaagguaucucuugguacgagacucuuuggacaugcauuaccccaauaguauucaaaugaaauauaacuaagaauucucuucccaaucuuuuuugcccacaucugcgauugacauggagauugaagaaaauuucacaucgguuccuauaaaucguucaauuuuaagaaauuucugcguuaugaguuaauugaaauugaucgacuaaaaagaaucccauucaacaauccagacacuuauu

SEQ ID NO: 1277 - RNA, 400 nt, Artificial Sequence
  Synthetic
agggcuucuuuuuccaggaagaguguauuuggaaaaaaauaauaaaaaagaaauucagucuaugaauguacacaacauguuugccgagcugaauagaaucaaaacugaggugccugucuuucaacacaucaacggaggcuuagagaguauuagcgugcucaugagaagaaguagagacagaaguaucgugagaguaguccugcgucuaagagggagauuggaacucuucucgguugaagucgaaggcguggcugcaaucaaauuucguaacucaauccucucaaugaccuagcuugacaccuuuauagugguagggcucuucagaguaaccuccaguagguguaggguaacuggucccuguuggcgaugcguaaccaccuguaccuguugcagacgggua

SEQ ID NO: 1278 - RNA, 398 nt, Artificial Sequence
  Synthetic
uuuguuuaauauuuugaauuuguuucucauuccauagccguagauuuucagauucgucuuccucuaugaguggauuuaugcaagcucggccugcuuccgaucggaaaugucgauuuaaggcaucugcacgagcaaagggacggccacagccccaaugaccaccauuuuuaaguucuccucuacaaauaaaucuuuuuucaccugaauguaggcucucaugucguuuucgaucaugcugacgcgcaaaagcuuuugugcacuuggaacagauaaaaggucgcucguuuguaugcguucggagaugggagcgaagauuauaggcgcgaguaaauuuuuuggggcaaagaugacauugauauguugcgggauguuuuuguacucgcucuagcuuggucuuc

SEQ ID NO: 1279 - RNA, 380 nt, Artificial Sequence
  Synthetic
ucgugguaugauuaguaauucuguaccugcagaccaaccaaugagcuuguaacaggaggugacucugaucgaccucuuauuucucagaaacaucuuuaucgagggcuagaacagaguucagaauuuuacucgguugcggucuauuugguugagugccaacuaaacugagucuucuagauaaaaucugaagcccucgaucauuauccgcacuuuccuuagcccucucuaaugccagagcucuauccucuucacuuguucguguaauuuccucaagacuuggaggcaaucuuucauucuuuaaaucuacuuuacgagcaucuucgaagccaguuauggcaucuuuaauaccuucagcuccaagcauaagaguaccugcgggu

SEQ ID NO: 1280 - RNA, 397 nt, Artificial Sequence
  Synthetic
gacauaauuacuguauaacguaauuuuuguaaucugaauaguuggcgcuauagcucguacaauuuuacuaucacuaucuuuuccggcugaauaauguuugcuuccgaguacaucguaaauuugucgccacgcacuuuugcgggcguuugauguucgccccguaaguaacccaauauuuucuccggacaacauaguuucuggcugauuagaguuguuuucuauaugacggggauuuguugcagcuuuucugagaguuuggcgaaaaugaaugccaacaaccaucuugaauagcuuuugcguagcuagcuguuaucuuuuccgagcuagcaaauaaauuuugcuuuuugagaggcuuagucgggaugauagugauaauuccgugcaauucaagcuguug

SEQ ID NO: 1281 - RNA, 390 nt, Artificial Sequence
  Synthetic
uuauuuauuauuaugcugugcuaauaugugugcuucaaauuccucuuggcuacuauaacccuaagacgcaaucacuaguguccauaugcuuagggucgcuggaugcgccagaaaaagugauaacucaagauuaccaauucacaaguauuagauccccucuacgcuuauccauauaacgaauauucacaauaauuuuauucucgucaucuuccucucaucauuucaacucgaugguguggcuuagggagaucaaauucgggcacugguauauuuagaauaaaaaagcuagccuaaaccaccccaaaccccucugauucgccuugcaagcugaaugucuuuuugcauuauaguaacacguuuagcaugaauagcgcauaaauuuguaucuuc

SEQ ID NO: 1282 - RNA, 393 nt, Artificial Sequence
  Synthetic
ucaucucgcuugccuauuccgagcuagcguauucucaacuucaaaaugauaccccgccaguucucauucauguuaccauccaaaauuaaauuuucauuuccugucagaaauuuccacuguucaacaacaaauaugucggucaaaacguucuucaaaguuaauugggagggaccaguucucgaccaggcuggucgaccaacugcuaagauugaaaaacaaucugggacuaucaaauucaaucuauuucagcaagauguuccgcuuacuguugaaaauuuccgugcucucuguacuggugaaaagggguuuggauacaagggcucugcuuuccaucguauuauuccucaauucauguugcaaggaggugauuucaccaggggaaauggcaccgga

SEQ ID NO: 1283 - RNA, 391 nt, Artificial Sequence
  Synthetic
uucaaguaauuuaacaaauauugcuuuuaugggaacauuagugcggucuggcuaugggcaagguauuguguaugcgacuggugaaaauacucacuuugguucaauagcugcagcuguaacaaagacagaaagcccuagaacaccccuucagcuuuccauggacucccuuggaucacauuuaagccaagcaucuuuuuugauaauugcuauuauuucuaugauuggaugguuucaaggaaaaggccuuuuagaaguguuuacuguuucuauaucuuuagcaguugcugcuauuccagaaggcuuaccuauaauuguaacuguaacuuuagcacuuggaguucauagaauggcaaagcagaacgcaauuguaaggaaaaugccaaguguagaa

SEQ ID NO: 1284 - RNA, 396 nt, Artificial Sequence
  Synthetic
aucacgcuuaaauucuuaucuuguucaauuucuugcaauuauggcugauucucuuacagaagagcagguaucugaguucaaagaagccuuuucuuuauuugauaaagauggagauggacaaauaacuacaaaagaacuagggacuguuaugcgaucccuuggacagaauccauccgagucagaacuucaggauaugauaaaugagguugacgcugacaauaaugguaccauugauuuuccagaauuucucacuaugauggcucgaaaaaugaaagacacagauucagaggaagaaauacgagaggcauucaaggucuuugaucgugauaauaauggcuuuaucucugcugcugaacuccgcuauguaaugacuucuaucggugagaagcucacuga

What is claimed is:

1. A composition for controlling *E. necator*, comprising a double-stranded RNA molecule that causes mortality, suppression of growth, decrease in virulence or pathogenicity or decrease in propagation/reproductive capacity in *E. necator* when transfected or contacted to said *E. necator*, said double-stranded RNA molecule having a first strand and a second strand, wherein the first strand and second strand are each about 600 nucleotides or less in length and the first strand comprises a nucleotide sequence comprising SEQ ID NO: 215 and the second strand comprises a nucleotide sequence that is complementary to SEQ ID NO: 215.

2. The composition of claim 1, wherein said composition is in the form of at least one selected from the group consisting of a solid, liquid, powder, suspension, spray, and carrier particulates.

3. The composition of claim 2, further comprising at least one component selected from the group consisting of a carrier agent, a surfactant, an organosilicone, an organosilicone surfactant, a polynucleotide herbicidal molecule, a non-polynucleotide herbicidal molecule, a non-polynucleotide pesticide, a polynucleotide pesticide, a safener, and a pathogen growth regulator.

4. A composition that inhibits expression of a *E. necator* target gene, comprising a dsRNA wherein a first strand and second strand of the dsRNA are each about 600 nucleotides or less in length and wherein the first strand comprises a nucleotide sequence comprising SEQ ID NO: 215 and the second strand comprises a nucleotide sequence that is complementary to SEQ ID NO: 215.

5. The composition of claim 4, wherein said composition is formulated for application in a form selected from the group consisting of a solid, liquid, powder, suspension, spray, and carrier particulates.

6. The composition of claim 5 further comprising one or more additional components, selected from the group consisting of a carrier agent, a surfactant, an organosilicone, an organosilicone surfactant, a polynucleotide herbicidal molecule, a non-polynucleotide herbicidal molecule, a polynucleotide pesticide, a non-polynucleotide pesticide, a polynucleotide fungicide, a non-polynucleotide fungicide, a polynucleotide insecticide, a non-polynucelotide insecticide, a safener, and a pathogen growth regulator.

7. A recombinant DNA construct encoding one or more strands of the dsRNA of claim 1.

8. The composition of claim 1, wherein the first strand comprises a conserved region of a target gene of two or more strains of *E. necator*.

9. The composition of claim 8, wherein the two or more strains are selected from the group consisting of LNYM, NY90, G14, Pumocnh, SHNC1, BLMT2, Dresden2, NCAES6, CH36, and CH19.

10. The composition of claim 8, wherein said conserved region of a target gene comprises the nucleotide sequence of SEQ ID NO: 108.

11. The composition of claim 1, wherein the first and second strands are between about 400 to about 600 nucleotides in length.

12. The composition of claim 11, wherein the first and second strands are between about 500 to about 600 nucleotides in length.

* * * * *